United States Patent
Milstein et al.

(10) Patent No.: US 11,034,957 B2
(45) Date of Patent: Jun. 15, 2021

(54) AMYLOID PRECURSOR PROTEIN (APP) RNAI AGENT COMPOSITIONS AND METHODS OF USE THEREOF

(71) Applicant: ALNYLAM PHARMACEUTICALS, INC., Cambridge, MA (US)

(72) Inventors: Stuart Milstein, Cambridge, MA (US); Kirk Brown, Cambridge, MA (US); Jayaprakash Nair, Cambridge, MA (US); Martin Maier, Cambridge, MA (US); Vasant Jadhav, Cambridge, MA (US); Mark Keating, Cambridge, MA (US); Adam Castoreno, Cambridge, MA (US); Patrick Haslett, Cambridge, MA (US); Mangala Meenakshi Soundarapandian, Cambridge, MA (US); Kevin Fitzgerald, Cambridge, MA (US)

(73) Assignee: ALNYLAM PHARMACEUTICALS, INC., Cambridge, MA (US)

( * ) Notice: Subject to any disclaimer, the term of this patent is extended or adjusted under 35 U.S.C. 154(b) by 0 days.

(21) Appl. No.: 16/925,286

(22) Filed: Jul. 9, 2020

(65) Prior Publication Data

US 2020/0339991 A1    Oct. 29, 2020

Related U.S. Application Data

(63) Continuation of application No. PCT/US2019/067449, filed on Dec. 19, 2019.

(60) Provisional application No. 62/928,795, filed on Oct. 31, 2019, provisional application No. 62/862,472, filed on Jun. 17, 2019, provisional application No. 62/781,774, filed on Dec. 19, 2018.

(51) Int. Cl.
| | | |
|---|---|---|
| C12N 15/11 | (2006.01) | |
| C12N 15/113 | (2010.01) | |
| A61K 9/00 | (2006.01) | |

(52) U.S. Cl.
CPC .......... *C12N 15/113* (2013.01); *A61K 9/0085* (2013.01); *C12N 2310/11* (2013.01); *C12N 2310/31* (2013.01); *C12N 2310/315* (2013.01); *C12N 2310/321* (2013.01); *C12N 2310/322* (2013.01)

(58) Field of Classification Search
CPC .............. A61K 31/713; A61K 31/7125; C12N 15/113; C12N 2310/14; C12N 2310/3515; C12N 15/111; C12N 2310/344; C12N 2320/51
See application file for complete search history.

(56) References Cited

U.S. PATENT DOCUMENTS

| | | | |
|---|---|---|---|
| 8,101,348 B2 | 1/2012 | Tuschl et al. | |
| 2005/0209179 A1* | 9/2005 | McSwiggen | C12Y 104/03003 514/44 A |
| 2008/0108801 A1* | 5/2008 | Manoharan | C12N 15/113 536/24.1 |
| 2012/0252875 A1 | 10/2012 | Feinstein et al. | |
| 2015/0105443 A1* | 4/2015 | Ohgi | A61K 47/64 514/44 A |
| 2019/0382772 A1* | 12/2019 | De Vlaam | C12N 15/1138 |

FOREIGN PATENT DOCUMENTS

| | | |
|---|---|---|
| WO | 2005/042777 A2 | 5/2005 |
| WO | 2014/089313 A1 | 6/2014 |

OTHER PUBLICATIONS

International Search Report and Written Opinion issued in corresponding PCT application No. PCT/US2019/67449, dated Jun. 10, 2020 (No. of pp. 26).
Hung et al., Drug candidates in clinical trials for Alzheimer's disease, J Biomed Sci, vol. 24, No. 47, Jul. 19, 2017, pp. 1-12.
Walsh et al.,The APP family of proteins: similarities and differences, Biochem Soc Trans., vol. 35 (Pt 2), Apr. 2007, pp. 416-420.
O'Brien et al., Amyloid precursor protein processing and Alzheimer's disease, Annu Rev Neurosci., vol. 34, Sep. 15, 2011, pp. 185-204.
Oberhauser et al.,Effective incorporation of 2'-O-methyl-oligoribonucleotides into liposomes and enhanced cell association through modification with thiocholesterol., Nucleic Acids Res., vol. 20, No. 3, Feb. 2011, pp. 533-538.
Kumar et al.,Site-directed antisense oligonucleotide decreases the expression of amyloid precursor protein and reverses deficits in learning and memory in aged SAMP8 mice., Peptides., vol. 21, 2000, pp. 1769-1775.

\* cited by examiner

*Primary Examiner* — Dana H Shin

(74) *Attorney, Agent, or Firm* — Withers Bergman LLP; Richard B. Emmons; Christopher R. Cowles

(57) ABSTRACT

The disclosure relates to double stranded ribonucleic acid (dsRNAi) agents and compositions targeting the APP gene, as well as methods of inhibiting expression of an APP gene and methods of treating subjects having an APP-associated disease or disorder, such as cerebral amyloid angiopathy (CAA) and early onset familial Alzheimer disease (EOFAD or eFAD), using such dsRNAi agents and compositions.

30 Claims, 43 Drawing Sheets
Specification includes a Sequence Listing.

hCAA Lead Identification Strategy

- 300+ siRNAs screened in vitro by transfection

- In vivo screens in mouse liver transduced with AAV-hAPP

- Convert duplexes to CNS conjugates and execute in vivo lead finding studies in NHP Tissue siRNA

| Animal ID | Matrix | Duplex Final (ng/g) |
|---|---|---|
| 4003 | Lumbar Cord | 8278 |
| 4004 | | 9686 |
| 4003 | Cervical Cord | 4906 |
| 4004 | | 3408 |
| 4003 | Prefrontal Cortex | 1910 |
| 4004 | | 6233 |
| 4003 | Temporal Cortex | 950 |
| 4004 | | 6384 |

| Matrix | Duplex Final (µg/g) |
|---|---|
| Lumbar Cord | 25.6 |
| Cervical Cord | 14.9 |
| Prefrontal Cortex | 36.7 |
| Temporal Cortex | 29.5 |

AD-886864

AD-886919

AD-886823

AMYLOID PRECURSOR PROTEIN (APP) RNAI AGENT COMPOSITIONS AND METHODS OF USE THEREOF

CROSS-REFERENCE TO RELATED APPLICATION

This application is a continuation of PCT Application No. PCT/US19/67449, filed Dec. 19, 2019, which claims the benefit of and priority to U.S. Provisional Application No. 62/928,795, filed Oct. 31, 2019, U.S. Provisional Application No. 62/862,472, filed Jun. 17, 2019, and U.S. Provisional Application No. 62/781,774, filed Dec. 19, 2018, the entire contents of which are hereby incorporated by reference.

FIELD OF THE INVENTION

The instant disclosure relates generally to APP-targeting RNAi agents and methods.

SEQUENCE LISTING

The instant application contains a Sequence Listing which has been filed electronically in ASCII format and is hereby incorporated by reference in its entirety. Said ASCII copy, created on Dec. 18, 2019, is named 53433_500WO01_SequenceListing_ST25.txt and is 632 kB in size.

BACKGROUND OF THE INVENTION

The amyloid precursor protein (APP) gene encodes an integral membrane protein expressed in neurons and glia. While the primary function of APP is unknown, secretase-cleaved forms of APP—particularly the Aβ cleavage forms of APP, e.g., Aβ(1-42) (aka Aβ42) and Aβ(1-40) (aka Aβ40) commonly found as the predominant protein in amyloid beta plaques—have long been described as associated with the development and progression of Alzheimer's disease (AD) in affected individuals. Indeed, identification of myloid beta plaques in a subject is necessary for pathological diagnosis of AD. Aβ cleavage forms of APP have been particularly described to play a critical and even causal role in the development of two AD-related/associated diseases: cerebral amyloid angiopathy (CAA) and early onset familial Alzheimer disease (EOFAD or eFAD).

Inhibition of the expression and/or activity of APP with an agent that can selectively and efficiently inhibit APP, and thereby block or dampen the production and/or levels of Aβ cleavage forms of APP, would be useful for preventing or treating a variety of APP-associated diseases and disorders, including AD, CAA and EOFAD, among others.

Current treatment options for APP-associated diseases and disorders are both limited and largely ineffective. There are no existing therapies for hereditary CAA, and attempts to treat sporadic forms of AD and EOFAD have to date proven unsuccessful—for example, all trials of BACE1 (β-secretase) inhibitors for treatment of sporadic AD have thus far failed (Egan et al. *The New England Journal of Medicine,* 378: 1691-1703; Hung and Fu. *Journal of Biomedical Science,* 24: 47). Meanwhile, a number of Aβ-directed immunotherapies are in various phases of development, while a number of human γ-secretase inhibitor programs have been halted for toxicity (Selkoe and Hardy. *EMBO Molecular Medicine,* 8: 595-608). To date, approved pharmacologic treatments for APP-associated diseases or disorders are directed to treatment of symptoms, not to prevention or cure, and such treatments are of limited efficacy, particularly as APP-associated diseases or disorders advance in an affected individual. Therefore, there is a need for therapies for subjects suffering from APP-associated diseases and disorders, including a particular need for therapies for subjects suffering from hereditary CAA and EOFAD.

BRIEF SUMMARY OF THE INVENTION

The present disclosure provides RNAi compositions which effect the RNA-induced silencing complex (RISC)-mediated cleavage of RNA transcripts of an amyloid precursor protein (APP) gene. The APP gene may be within a cell, e.g., a cell within a subject, such as a human. The present disclosure also provides methods of using the RNAi compositions of the disclosure for inhibiting the expression of an APP gene and/or for treating a subject who would benefit from inhibiting or reducing the expression of an APP gene, e.g., a subject suffering or prone to suffering from an APP-associated disease, for example, cerebral amyloid angiopathy (CAA) or Alzheimer's disease (AD), e.g., early onset familial Alzheimer disease (EOFAD).

Accordingly, in one aspect, the instant disclosure provides a double stranded ribonucleic acid (RNAi) agent for inhibiting expression of an amyloid precursor protein (APP) gene, where the RNAi agent includes a sense strand and an antisense strand, and where the antisense strand includes a region of complementarity which includes at least 15 contiguous nucleotides differing by no more than 3 nucleotides from any one of the antisense sequences listed in any one of Tables 2A, 2B, 3, 5A, 5B, 6, 9, 10-15, 16A, 16B, 26, and 30. In certain embodiments, thymine-to-uracil and/or uracil-to-thymine differences between aligned (compared) sequences are not counted as nucleotides that differ between the aligned (compared) sequences.

Another aspect of the instant disclosure provides a double stranded RNAi agent for inhibiting expression of an amyloid precursor protein (APP) gene, where the dsRNA agent includes a sense strand and an antisense strand, where the sense strand includes at least 15 contiguous nucleotides differing by no more than 3 nucleotides from any one of the sense strand sequences presented in Tables 2A, 2B, 3, 5A, 5B, 6, 9, 10-15, 16A, 16B, 26, and 30; and where the antisense strand includes at least 15 contiguous nucleotides differing by no more than 3 nucleotides from any one of antisense strand nucleotide sequences presented in Tables 2A, 2B, 3, 5A, 5B, 6, 9, 10-15, 16A, 16B, 26, and 30.

In one embodiment, at least one of the sense strand and the antisense strand of the double stranded RNAi agent includes one or more lipophilic moieties conjugated to one or more internal nucleotide positions, optionally via a linker or carrier.

An additional aspect of the disclosure provides a double stranded RNAi agent for inhibiting expression of an amyloid precursor protein (APP) gene, where the dsRNA agent includes a sense strand and an antisense strand, where the sense strand includes at least 15 contiguous nucleotides differing by no more than 3 nucleotides from any one of the nucleotide sequences of SEQ ID NOs: 1-14, where a substitution of a uracil for any thymine of SEQ ID NOs: 1-14 (when comparing aligned sequences) does not count as a difference that contributes to the differing by no more than 3 nucleotides from any one of the nucleotide sequences of SEQ ID NOs: 1-14; and where the antisense strand includes at least 15 contiguous nucleotides differing by no more than 3 nucleotides from any one of the nucleotide sequences of SEQ ID NOs: 15-28, where a substitution of a uracil for any thymine of SEQ ID NOs: 15-28 (when comparing aligned sequences) does not count as a difference that contributes to the differing by no more than 3 nucleotides from any one of the nucleotide sequences of SEQ ID NOs: 15-28, where at least one of the sense strand and the antisense strand includes one or more lipophilic moieties conjugated to one or more internal nucleotide positions, optionally via a linker or carrier.

In one embodiment, the double stranded RNAi agent sense strand includes at least 15 contiguous nucleotides differing by no more than 3 nucleotides from the nucleotide sequence of the sense strand nucleotide sequence of an AD-392911, AD-392912, AD-392816, AD-392704, AD-392843, AD-392855, AD-392840, AD-392835, AD-392729, AD-392916, AD-392876, AD-392863, AD-392917, AD-392783, AD-392765, AD-392791, AD-392800, AD-392711, AD-392801, AD-392826, AD-392818, AD-392792, AD-392802, AD-392766, AD-392767, AD-392834, AD-392974, AD-392784, AD-392744, AD-392752, AD-392737, AD-392918, AD-392919, AD-392803, AD-392804, AD-392827, AD-392828, AD-392785, AD-392829, AD-392920, AD-392921, AD-392768, AD-392805, AD-392769, AD-392753, AD-392714, AD-392703, AD-392715, AD-392836, AD-392966, AD-392832, AD-392972, AD-392961, AD-392967, AD-392894, AD-392864, AD-392865, AD-392922, AD-392828, AD-392785, AD-392833, AD-392968, AD-392962, AD-392963, AD-392962, AD-392963, AD-392969, AD-392973, AD-392923, AD-392866, AD-392877, AD-392707, AD-392926, AD-392927, AD-392717, AD-392700, AD-392878, AD-392718, AD-392929, AD-392819, AD-392745, AD-392770, AD-392806, AD-392771, AD-392820, AD-392821, AD-392820, AD-392821, AD-392786, AD-392772, AD-392699, AD-392868, AD-392699, AD-392868, AD-392719, AD-392880, AD-392930, AD-392932, AD-392930, AD-392932, AD-392869, AD-392870, AD-392896, AD-392720, AD-392896, AD-392720, AD-392746, AD-392773, AD-392807, AD-392730, AD-392807, AD-392730, AD-392721, AD-392933, AD-392881, AD-392897, AD-392881, AD-392897, AD-392898, AD-392899, AD-392935, AD-392882, AD-392935, AD-392882, AD-392738, AD-392739, AD-392936, AD-392900, AD-392936, AD-392900, AD-392901, AD-392937, AD-392883, AD-392975, AD-392883, AD-392975, AD-392938, AD-392902, AD-392941, AD-392942, AD-392941, AD-392942, AD-392943, AD-392944, AD-392903, AD-392775, AD-392903, AD-392775, AD-392758, AD-392945, AD-392884, AD-392947, AD-392884, AD-392947, AD-392748, AD-392759, AD-392837, AD-392970, AD-392837, AD-392970, AD-392976, AD-392965, AD-392831, AD-392904, AD-392831, AD-392904, AD-392885, AD-392886, AD-392776, AD-392887, AD-392776, AD-392887, AD-392722, AD-392760, AD-392731, AD-392709, AD-392731, AD-392709, AD-392723, AD-392948, AD-392724, AD-392949, AD-392724, AD-392949, AD-392725, AD-392950, AD-392732, AD-392726, AD-392732, AD-392726, AD-392862, AD-392951, AD-392871, AD-392872, AD-392871, AD-392872, AD-397183, AD-397175, AD-397177, AD-397176, AD-397177, AD-397176, AD-397260, AD-397266, AD-397267, AD-397178, AD-397267, AD-397178, AD-397180, AD-397184, AD-397179, AD-397224, AD-397179, AD-397224, AD-397225, AD-397203, AD-397185, AD-397195, AD-397185, AD-397195, AD-397204, AD-397191, AD-397251, AD-397240, AD-397251, AD-397240, AD-397205, AD-397254, AD-397259, AD-397247, AD-397259, AD-397247, AD-397233, AD-397181, AD-397196, AD-397197, AD-397196, AD-397197, AD-397226, AD-397212, AD-397182, AD-397227, AD-397182, AD-397227, AD-397217, AD-397213, AD-397229, AD-397264, AD-397229, AD-397264, AD-397265, AD-397209, AD-397192, AD-397210, AD-397192, AD-397210, AD-397219, AD-397214, AD-397220, AD-397230, AD-397220, AD-397230, AD-397231, AD-397193, AD-397190, AD-397200, AD-397190, AD-397200, AD-397248, AD-397207, AD-397211, AD-397243, AD-397211, AD-397243, AD-397246, AD-397223, AD-397202, AD-397256, AD-397202, AD-397256, AD-397257, AD-397258, AD-397250, AD-397244, AD-397250, AD-397244, AD-454972, AD-454973, AD-454842, AD-454843, AD-454842, AD-454843, AD-454844, AD-994379, AD-961583, AD-961584, AD-961585, or AD-961586 duplex.

In another embodiment, the double stranded RNAi agent antisense strand includes at least 15 contiguous nucleotides differing by no more than 3 nucleotides from the antisense nucleotide sequence of an AD-392911, AD-392912, AD-392816, AD-392704, AD-392843, AD-392855, AD-392840, AD-392835, AD-392729, AD-392916, AD-392876, AD-392863, AD-392917, AD-392783, AD-392765, AD-392791, AD-392800, AD-392711, AD-392801, AD-392826, AD-392818, AD-392792, AD-392802, AD-392766, AD-392767, AD-392834, AD-392974, AD-392784, AD-392744, AD-392752, AD-392737, AD-392918, AD-392919, AD-392803, AD-392804, AD-392827, AD-392828, AD-392785, AD-392829, AD-392920, AD-392921, AD-392768, AD-392805, AD-392769, AD-392753, AD-392714, AD-392703, AD-392715, AD-392836, AD-392966, AD-392832, AD-392972, AD-392961, AD-392967, AD-392894, AD-392864, AD-392865, AD-392922, AD-392833, AD-392968, AD-392962, AD-392963, AD-392969, AD-392973, AD-392923, AD-392866, AD-392877, AD-392707, AD-392926, AD-392927, AD-392717, AD-392700, AD-392878, AD-392718, AD-392929, AD-392819, AD-392745, AD-392770, AD-392806, AD-392771, AD-392820, AD-392821, AD-392786, AD-392772, AD-392699, AD-392868, AD-392719, AD-392880, AD-392930, AD-392932, AD-392869, AD-392870, AD-392896, AD-392720, AD-392746, AD-392773, AD-392807, AD-392730, AD-392721, AD-392933, AD-392881, AD-392897, AD-392898, AD-392899, AD-392935, AD-392882, AD-392738, AD-392739, AD-392936, AD-392900, AD-392901, AD-392937, AD-392883, AD-392975, AD-392938, AD-392902, AD-392941, AD-392942, AD-392943, AD-392944, AD-392903, AD-392775, AD-392758, AD-392945, AD-392884, AD-392947, AD-392748, AD-392759, AD-392837, AD-392970, AD-392976, AD-392965, AD-392831, AD-392904, AD-392885, AD-392886, AD-392776, AD-392887, AD-392722, AD-392760, AD-392731, AD-392709, AD-392723, AD-392948, AD-392724, AD-392949, AD-392725, AD-392950, AD-392732, AD-392726, AD-392862, AD-392951, AD-392871, AD-392872, AD-397183, AD-397175, AD-397177, AD-397176, AD-397260, AD-397266, AD-397267, AD-397178, AD-397180, AD-397184, AD-397179, AD-397224, AD-397225, AD-397203, AD-397185, AD-397195, AD-397204, AD-397191, AD-397251, AD-397240, AD-397205, AD-397254, AD-397259, AD-397247, AD-397233, AD-397181, AD-397196, AD-397197, AD-397226, AD-397212, AD-397182, AD-397227, AD-397217, AD-397213, AD-397229, AD-397264, AD-397265, AD-397209, AD-397192, AD-397210, AD-397219, AD-397214, AD-397220, AD-397230, AD-397231, AD-397193, AD-397190, AD-397200, AD-397248, AD-397207, AD-397211, AD-397243, AD-397246, AD-397223, AD-397202, AD-397256, AD-397257, AD-397258, AD-397250, AD-397244, AD-454972, AD-454973, AD-454842, AD-454843, AD-454844, AD-994379, AD-961583, AD-961584, AD-961585, or AD-961586 duplex.

Optionally, the double stranded RNAi agent includes at least one modified nucleotide.

In certain embodiments, the lipophilicity of the lipophilic moiety, measured by log $K_{ow}$, exceeds 0.

In some embodiments, the hydrophobicity of the double-stranded RNAi agent, measured by the unbound fraction in a plasma protein binding assay of the double-stranded RNAi agent, exceeds 0.2. In a related embodiment, the plasma protein binding assay is an electrophoretic mobility shift assay using human serum albumin protein.

In certain embodiments, all of the nucleotides of the sense strand are modified nucleotides.

In some embodiments, substantially all of the nucleotides of the antisense strand are modified nucleotides. Optionally, all of the nucleotides of the sense strand are modified nucleotides.

In certain embodiments, all of the nucleotides of the antisense strand are modified nucleotides. Optionally, all of the nucleotides of the sense strand and all of the nucleotides of the antisense strand are modified nucleotides.

In one embodiment, at least one of the modified nucleotides is a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5' phosphate or 5' phosphate mimic, a nucleotide comprising vinyl phosphate, a nucleotide comprising adenosine-glycol nucleic acid (GNA), a nucleotide comprising thymidine-glycol nucleic acid (GNA)S-Isomer, a nucleotide comprising 2-hydroxymethyl-tetrahydrofurane-5-phosphate, a nucleotide comprising 2'-deoxythymidine-3'phosphate, a nucleotide comprising 2'-deoxyguanosine-3'-phosphate, or a terminal nucleotide linked to a cholesteryl derivative and/or a dodecanoic acid bisdecylamide group.

In a related embodiment, the modified nucleotide is a 2'-deoxy-2'-fluoro modified nucleotide, a 2'-deoxy-modified nucleotide, 3'-terminal deoxy-thymine nucleotides (dT), a locked nucleotide, an abasic nucleotide, a 2'-amino-modified nucleotide, a 2'-alkyl-modified nucleotide, a morpholino nucleotide, a phosphoramidate, and/or a non-natural base comprising nucleotide.

In one embodiment, the modified nucleotide includes a short sequence of 3'-terminal deoxy-thymine nucleotides (dT).

In another embodiment, the modifications on the nucleotides are 2'-O-methyl, 2'fluoro and GNA modifications.

In an additional embodiment, the double stranded RNAi agent includes at least one phosphorothioate internucleotide linkage. Optionally, the double stranded RNAi agent includes 6-8 phosphorothioate internucleotide linkages.

In certain embodiments, the region of complementarity is at least 17 nucleotides in length. Optionally, the region of complementarity is 19-23 nucleotides in length. Optionally, the region of complementarity is 19 nucleotides in length.

In one embodiment, each strand is no more than 30 nucleotides in length.

In another embodiment, at least one strand includes a 3' overhang of at least 1 nucleotide. Optionally, at least one strand includes a 3' overhang of at least 2 nucleotides.

In certain embodiments, the double stranded RNAi agent further includes a C16 ligand conjugated to the 3' end, the 5' end, or the 3' end and the 5' end of the sense strand through a monovalent or branched bivalent or trivalent linker.

In one embodiment, the ligand is

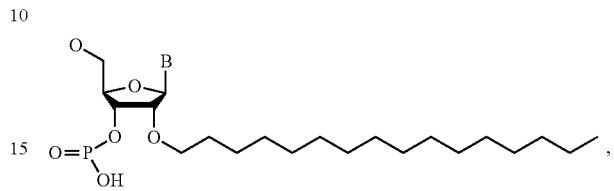

where B is a nucleotide base or a nucleotide base analog, optionally where B is adenine, guanine, cytosine, thymine or uracil.

In another embodiment, the region of complementarity includes any one of the antisense sequences in any one of Tables 2A, 2B, 3, 5A, 5B, 6, 9, 10-15, 16A, 16B, 26 and 30.

In an additional embodiment, the region of complementarity is that of any one of the antisense sequences in any one of Tables 2A, 2B, 3, 5A, 5B, 6, 9, 10-15, 16A, 16B, 26 and 30.

In some embodiments, the internal nucleotide positions include all positions except the terminal two positions from each end of the strand.

In a related embodiment, the internal positions include all positions except terminal three positions from each end of the strand. Optionally, the internal positions exclude the cleavage site region of the sense strand.

In one embodiment, the internal positions exclude positions 9-12, counting from the 5'-end of the sense strand.

In another embodiment, the internal positions exclude positions 11-13, counting from the 3'-end of the sense strand. Optionally, the internal positions exclude the cleavage site region of the antisense strand.

In one embodiment, the internal positions exclude positions 12-14, counting from the 5'-end of the antisense strand.

In another embodiment, the internal positions excluding positions 11-13 on the sense strand, counting from the 3'-end, and positions 12-14 on the antisense strand, counting from the 5'-end.

In an additional embodiment, one or more lipophilic moieties are conjugated to one or more of the following internal positions: positions 4-8 and 13-18 on the sense strand, and positions 6-10 and 15-18 on the antisense strand, counting from the 5'end of each strand. Optionally, one or more lipophilic moieties are conjugated to one or more of the following internal positions: positions 5, 6, 7, 15, and 17 on the sense strand, and positions 15 and 17 on the antisense strand, counting from the 5'-end of each strand.

In certain embodiments, the lipophilic moiety is an aliphatic, alicyclic, or polyalicyclic compound. Optionally, the lipophilic moiety is lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine.

In some embodiments, the lipophilic moiety contains a saturated or unsaturated $C_4$-$C_{30}$ hydrocarbon chain, and an optional functional group selected that is hydroxyl, amine, carboxylic acid, sulfonate, phosphate, thiol, azide, and/or alkyne.

In certain embodiments, the lipophilic moiety contains a saturated or unsaturated $C_6$-$C_{18}$ hydrocarbon chain. Optionally, the lipophilic moiety contains a saturated or unsaturated $C_{16}$ hydrocarbon chain. In a related embodiment, the lipophilic moiety is conjugated via a carrier that replaces one or more nucleotide(s) in the internal position(s). In certain embodiments, the carrier is a cyclic group that is pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, or decalinyl; or is an acyclic moiety based on a serinol backbone or a diethanolamine backbone.

In some embodiments, the lipophilic moiety is conjugated to the double-stranded RNAi agent via a linker containing an ether, thioether, urea, carbonate, amine, amide, maleimide-thioether, disulfide, phosphodiester, sulfonamide linkage, a product of a click reaction, or carbamate.

In one embodiment, the lipophilic moiety is conjugated to a nucleobase, sugar moiety, or internucleosidic linkage.

In another embodiment, the double-stranded RNAi agent further includes a phosphate or phosphate mimic at the 5'-end of the antisense strand. Optionally, the phosphate mimic is a 5'-vinyl phosphonate (VP).

In certain embodiments, the double-stranded RNAi agent further includes a targeting ligand that targets a receptor which mediates delivery to a CNS tissue. In one embodiment, the targeting ligand is a C16 ligand.

In some embodiments, the double-stranded RNAi agent further includes a targeting ligand that targets a brain tissue.

In one embodiment, the lipophilic moiety or targeting ligand is conjugated via a bio-cleavable linker that is DNA, RNA, disulfide, amide, functionalized monosaccharides or oligosaccharides of galactosamine, glucosamine, glucose, galactose, mannose, and/or a combination thereof.

In a related embodiment, the 3' end of the sense strand is protected via an end cap which is a cyclic group having an amine, the cyclic group being pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, or decalinyl.

In one embodiment, the RNAi agent includes at least one modified nucleotide that is a 2'-O-methyl modified nucleotide, a 2'-fluoro modified nucleotide, a nucleotide that includes a glycol nucleic acid (GNA) and/or a nucleotide that includes a vinyl phosphate. Optionally, the RNAi agent includes at least one of each of the following modifications: 2'-O-methyl modified nucleotide, a 2'-fluoro modified nucleotide, a nucleotide comprising a glycol nucleic acid (GNA) and a nucleotide comprising vinyl phosphate.

In another embodiment, the RNAi agent includes a pattern of modified nucleotides as shown in FIG. 1A, FIG. 1B, Table 2A, Table 5A, or Table 9 (where locations of 2'-C16, 2'-O-methyl, GNA, phosphorothioate and 2'-fluoro modifications are as displayed in FIG. 1A, FIG. 1B, Table 2A, Table 5A, or Table 9, irrespective of the individual nucleotide base sequences of the displayed RNAi agents).

Another aspect of the instant disclosure provides a double stranded RNAi agent for inhibiting expression of an amyloid precursor protein (APP) gene, where the double stranded RNAi agent includes a sense strand complementary to an antisense strand, where the antisense strand includes a region complementary to part of an mRNA encoding APP, where each strand is about 14 to about 30 nucleotides in length, where the double stranded RNAi agent is represented by formula (III):

sense: $5'n_p\text{-}N_a\text{-}(XXX)_i\text{-}N_b\text{-}YYY\text{-}N_b\text{-}(ZZZ)_j\text{-}N_a\text{-}n_q 3'$ antisense: $3'n_p'\text{-}N_a'\text{-}(X'X'X')_k\text{-}N_b'\text{-}Y'Y'Y'\text{-}N_b'\text{-}(Z'Z'Z')_l\text{-}N_a'\text{-}n_q'5'$ (III)

where:
j, k, and l are each independently 0 or 1;
p, p', q, and q' are each independently 0-6;
each $N_a$ and $N_a'$ independently represents an oligonucleotide sequence including 0-25 nucleotides which are either modified or unmodified or combinations thereof, each sequence including at least two differently modified nucleotides;
each $N_b$ and $N_b'$ independently represents an oligonucleotide sequence including 0-10 nucleotides which are either modified or unmodified or combinations thereof;
each $n_p$, $n_p'$, $n_q$, and $n_q'$, each of which may or may not be present, independently represents an overhang nucleotide;
XXX, YYY, ZZZ, X'X'X', Y'Y'Y', and Z'Z'Z' each independently represent one motif of three identical modifications on three consecutive nucleotides;
modifications on $N_b$ differ from the modification on Y and modifications on $N_b'$ differ from the modification on Y; and
where the sense strand is conjugated to at least one ligand.

In one embodiment, i is 0; j is 0; i is 1; j is 1; both i and j are 0; or both i and j are 1.

In another embodiment, k is 0; l is 0; k is 1; l is 1; both k and l are 0; or both k and l are 1.

In certain embodiments, XXX is complementary to X'X'X', YYY is complementary to Y'Y'Y', and ZZZ is complementary to Z'Z'Z'.

In another embodiment, the YYY motif occurs at or near the cleavage site of the sense strand.

In an additional embodiment, the Y'Y'Y' motif occurs at the 11, 12 and 13 positions of the antisense strand from the 5'-end. Optionally, the Y' is 2'-O-methyl.

In some embodiments, formula (III) is represented by formula (IIIa):

sense: $5'n_p\text{-}N_a\text{-}YYY\text{-}N_a\text{-}n_q 3'$ antisense: $3'n_p'\text{-}N_a'\text{-}Y'Y'Y'\text{-}N_a'\text{-}n_q'5'$ (IIIa).

In another embodiment, formula (III) is represented by formula (IIIb):

sense: $5'n_p\text{-}N_a\text{-}YYY\text{-}N_b\text{-}ZZZ\text{-}N_a\text{-}n_q 3'$ antisense: $3'n_p'\text{-}N_a'\text{-}Y'Y'Y'\text{-}N_b'\text{-}Z'Z'Z'\text{-}N_a'\text{-}n_q'5'$ (IIIb)

where each $N_b$ and $N_b'$ independently represents an oligonucleotide sequence including 1-5 modified nucleotides.

In an additional embodiment, formula (III) is represented by formula (IIIc):

sense: $5'n_p\text{-}N_a\text{-}XXX\text{-}N_b\text{-}YYY\text{-}N_a\text{-}n_q 3'$ antisense: $3'n_p'\text{-}N_a'\text{-}X'X'X'\text{-}N_b'\text{-}Y'Y'Y'\text{-}N_a'\text{-}n_q'5'$ (IIIc)

where each $N_b$ and $N_b'$ independently represents an oligonucleotide sequence including 1-5 modified nucleotides.

In certain embodiments, formula (III) is represented by formula (IIId):

sense: $5'n_p\text{-}N_a\text{-}XXX\text{-}N_b\text{-}YYY\text{-}N_b\text{-}ZZZ\text{-}N_a\text{-}n_q 3'$ antisense: $3'n_p'\text{-}N_a'\text{-}X'X'X'\text{-}N_b'\text{-}Y'Y'Y'\text{-}N_b'\text{-}Z'Z'Z'\text{-}N_a'\text{-}n_q'5'$ (IIId)

where each $N_b$ and $N_b'$ independently represents an oligonucleotide sequence including 1-5 modified nucleotides and each $N_a$ and $N_a'$ independently represents an oligonucleotide sequence including 2-10 modified nucleotides.

In another embodiment, the double stranded region is 15-30 nucleotide pairs in length. Optionally, the double stranded region is 17-23 nucleotide pairs in length.

In certain embodiments, the double stranded region is 17-25 nucleotide pairs in length. Optionally, the double stranded region is 23-27 nucleotide pairs in length.

In some embodiments, the double stranded region is 19-21 nucleotide pairs in length. Optionally, the double stranded region is 21-23 nucleotide pairs in length.

In certain embodiments, each strand has 15-30 nucleotides. Optionally, each strand has 19-30 nucleotides.

In another embodiment, the modifications on the nucleotides of the RNAi agent are LNA, glycol nucleic acid (GNA), HNA, CeNA, 2'-methoxyethyl, 2'-O-alkyl, 2'-O-allyl, 2'-C-allyl, 2'-fluoro, 2'-deoxy and/or 2'-hydroxyl, and combinations thereof. Optionally, the modifications on nucleotides include 2'-O-methyl, 2'-fluoro and/or GNA, and combinations thereof. In a related embodiment, the modifications on the nucleotides are 2'-O-methyl or 2'-fluoro modifications.

In one embodiment the RNAi agent includes a ligand that is or includes one or more C16 moieties attached through a bivalent or trivalent branched linker.

In certain embodiments, the ligand is attached to the 3' end of the sense strand.

In some embodiments, the RNAi agent further includes at least one phosphorothioate or methylphosphonate internucleotide linkage. In a related embodiment, the phosphorothioate or methylphosphonate internucleotide linkage is at the 3'-terminus of one strand. Optionally, the strand is the antisense strand. In another embodiment, the strand is the sense strand. In a related embodiment, the phosphorothioate or methylphosphonate internucleotide linkage is at the 5'-terminus of one strand. Optionally, the strand is the antisense strand. In another embodiment, the strand is the sense strand.

In another embodiment, the phosphorothioate or methylphosphonate internucleotide linkage is at the both the 5'- and 3'-terminus of one strand. Optionally, the strand is the antisense strand. In another embodiment, the strand is the sense strand.

In an additional embodiment, the base pair at the 1 position of the 5'-end of the antisense strand of the RNAi agent duplex is an A:U base pair.

In certain embodiments, the Y nucleotides contain a 2'-fluoro modification.

In some embodiments, the Y' nucleotides contain a 2'-O-methyl modification.

In certain embodiments, p'>0. Optionally, p'=2.

In some embodiments, q'=0, p=0, q=0, and p' overhang nucleotides are complementary to the target mRNA.

In certain embodiments, q'=0, p=0, q=0, and p' overhang nucleotides are non-complementary to the target mRNA.

In one embodiment, the sense strand of the RNAi agent has a total of 21 nucleotides and the antisense strand has a total of 23 nucleotides.

In another embodiment, at least one $n_p'$ is linked to a neighboring nucleotide via a phosphorothioate linkage. Optionally, all $n_p'$ are linked to neighboring nucleotides via phosphorothioate linkages.

In certain embodiments, the RNAi agent of the instant disclosure is one of those listed in Table 2A, 2B, 3, 5A, 5B, 6 and/or 9.

In some embodiments, all of the nucleotides of the sense strand and all of the nucleotides of the antisense strand include a modification.

Another aspect of the instant disclosure provides a double stranded RNAi agent for inhibiting expression of an amyloid precursor protein (APP) gene in a cell, where the double stranded RNAi agent includes a sense strand complementary to an antisense strand, where the antisense strand includes a region complementary to part of an mRNA encoding APP, where each strand is about 14 to about 30 nucleotides in length, where the double stranded RNAi agent is represented by formula (III):

sense: 5'$n_p$-$N_a$-(XXX)$_i$-$N_b$-YYY-$N_b$-(ZZZ)$_j$-$N_a$-$n_q$3' antisense: 3'$n_p'$-$N_a'$-(X'X'X')$_k$-$N_b'$-Y'Y'Y'-$N_b'$-(Z'Z'Z')$_l$-$N_a'$-$n_q'$5'  (III)

where:
j, k, and l are each independently 0 or 1;
p, p', q, and q' are each independently 0-6;
each $N_a$ and $N_a'$ independently represents an oligonucleotide sequence including 0-25 nucleotides which are either modified or unmodified or combinations thereof, each sequence including at least two differently modified nucleotides;
each $N_b$ and $N_b'$ independently represents an oligonucleotide sequence including 0-10 nucleotides which are either modified or unmodified or combinations thereof;
each $n_p$, $n_p'$, $n_q$, and $n_q'$, each of which may or may not be present independently represents an overhang nucleotide;
XXX, YYY, ZZZ, X'X'X', Y'Y'Y', and Z'Z'Z' each independently represent one motif of three identical modifications on three consecutive nucleotides, and where the modifications are 2'-O-methyl or 2'-fluoro modifications;
modifications on $N_b$ differ from the modification on Y and modifications on $N_b'$ differ from the modification on Y'; and where the sense strand is conjugated to at least one ligand.

An additional aspect of the instant disclosure provides a double stranded RNAi agent for inhibiting expression of an amyloid precursor protein (APP) gene in a cell, where the double stranded RNAi agent includes a sense strand complementary to an antisense strand, where the antisense strand includes a region complementary to part of an mRNA encoding APP, where each strand is about 14 to about 30 nucleotides in length, where the double stranded RNAi agent is represented by formula (III):

sense: 5'$n_p$-$N_a$-(XXX)$_i$-$N_b$-YYY-$N_b$-(ZZZ)$_j$-$N_a$-$n_q$3' antisense: 3'$n_p'$-$N_a'$-(X'X'X')$_k$-$N_b'$-Z'Z'Z'-$N_b'$-(Z'Z'Z')$_l$-$N_a'$-$n_q'$5'  (III)

where:
i, j, k, and l are each independently 0 or 1;
each $n_p$, $n_q$, and $n_q'$, each of which may or may not be present, independently represents an overhang nucleotide;
p, q, and q' are each independently 0-6;
$n_p'$>0 and at least one $n_p'$ is linked to a neighboring nucleotide via a phosphorothioate linkage;
each $N_a$ and $N_a'$ independently represents an oligonucleotide sequence including 0-25 nucleotides which are either modified or unmodified or combinations thereof, each sequence including at least two differently modified nucleotides;
each $N_b$ and $N_b'$ independently represents an oligonucleotide sequence including 0-10 nucleotides which are either modified or unmodified or combinations thereof;
XXX, YYY, ZZZ, X'X'X', Y'Y'Y', and Z'Z'Z' each independently represent one motif of three identical modifications on three consecutive nucleotides, and where the modifications are 2'-O-methyl, glycol nucleic acid (GNA) or 2'-fluoro modifications;
modifications on $N_b$ differ from the modification on Y and modifications on $N_b'$ differ from the modification on Y; and where the sense strand is conjugated to at least one ligand.

Another aspect of the instant disclosure provides a double stranded RNAi agent for inhibiting expression of an amyloid precursor protein (APP) gene in a cell, where the double stranded RNAi agent includes a sense strand complementary to an antisense strand, where the antisense strand includes a region complementary to part of an mRNA encoding APP, where each strand is about 14 to about 30 nucleotides in length, where the double stranded RNAi agent is represented by formula (III):

sense: 5'$n_p$-$N_a$-(XXX)$_i$-$N_b$-YYY-$N_b$-(ZZZ)$_j$-$N_a$-$n_q$3' antisense: 3'$n_p$'-$N_a$'-(X'X'X')$_k$-$N_b$'-Z'Z'Z')$_l$-$N_a$'-$n_q$'5'  (III)

where:
i, j, k, and l are each independently 0 or 1;
each $n_p$, $n_q$, and $n_q$', each of which may or may not be present, independently represents an overhang nucleotide;
p, q, and q' are each independently 0-6;
$n_p$'>0 and at least one $n_p$' is linked to a neighboring nucleotide via a phosphorothioate linkage;
each $N_a$ and $N_a$' independently represents an oligonucleotide sequence including 0-25 nucleotides which are either modified or unmodified or combinations thereof, each sequence including at least two differently modified nucleotides;
each $N_b$ and $N_b$' independently represents an oligonucleotide sequence including 0-10 nucleotides which are either modified or unmodified or combinations thereof;
XXX, YYY, ZZZ, X'X'X', Y'Y'Y', and Z'Z'Z' each independently represent one motif of three identical modifications on three consecutive nucleotides, and where the modifications are 2'-O-methyl or 2'-fluoro modifications;
modifications on $N_b$ differ from the modification on Y and modifications on $N_b$' differ from the modification on Y; and
where the sense strand is conjugated to at least one ligand, optionally where the ligand is one or more C16 ligands.

An additional aspect of the instant disclosure provides a double stranded RNAi agent for inhibiting expression of an amyloid precursor protein (APP) gene in a cell, where the double stranded RNAi agent includes a sense strand complementary to an antisense strand, where the antisense strand includes a region complementary to part of an mRNA encoding APP, where each strand is about 14 to about 30 nucleotides in length, where the double stranded RNAi agent is represented by formula (III):

sense: 5'$n_p$-$N_a$-(XXX)$_i$-$N_b$-YYY-$N_b$-(ZZZ)$_j$-$N_a$-$n_q$3' antisense: 3'$n_p$'-$N_a$'-(X'X'X')$_k$-$N_b$'-Y'Y'Y'-$N_b$'-(Z'Z'Z')$_l$-$N_a$'-$n_q$'5'  (III)

where:
j, k, and l are each independently 0 or 1;
each $n_p$, $n_q$, and $n_q$', each of which may or may not be present, independently represents an overhang nucleotide;
p, q, and q' are each independently 0-6;
$n_p$'>0 and at least one $n_p$' is linked to a neighboring nucleotide via a phosphorothioate linkage;
each $N_a$ and $N_a$' independently represents an oligonucleotide sequence including 0-25 nucleotides which are either modified or unmodified or combinations thereof, each sequence including at least two differently modified nucleotides;
each $N_b$ and $N_b$' independently represents an oligonucleotide sequence including 0-10 nucleotides which are either modified or unmodified or combinations thereof;
XXX, YYY, ZZZ, X'X'X', Y'Y'Y', and Z'Z'Z' each independently represent one motif of three identical modifications on three consecutive nucleotides, and where the modifications are 2'-O-methyl or 2'-fluoro modifications;
modifications on $N_b$ differ from the modification on Y and modifications on $N_b$' differ from the modification on Y';
where the sense strand includes at least one phosphorothioate linkage; and
where the sense strand is conjugated to at least one ligand, optionally where the ligand is one or more C16 ligands.

Another aspect of the instant disclosure provides a double stranded RNAi agent for inhibiting expression of an amyloid precursor protein (APP) gene in a cell, where the double stranded RNAi agent includes a sense strand complementary to an antisense strand, where the antisense strand includes a region complementary to part of an mRNA encoding APP, where each strand is about 14 to about 30 nucleotides in length, where the double stranded RNAi agent is represented by formula (III):

sense: 5'$n_p$-$N_a$-YYY-$N_a$-$n_q$3' antisense: 3'$n_p$'-$N_a$'-Y'Y'Y'-$N_a$'-$n_q$'5'  (IIIa)

where:
each $n_p$, $n_q$, and $n_q$', each of which may or may not be present, independently represents an overhang nucleotide;
p, q, and q' are each independently 0-6;
$n_p$'>0 and at least one $n_p$' is linked to a neighboring nucleotide via a phosphorothioate linkage;
each $N_a$ and $N_a$' independently represents an oligonucleotide sequence including 0-25 nucleotides which are either modified or unmodified or combinations thereof, each sequence including at least two differently modified nucleotides;
YYY and Y'Y'Y' each independently represent one motif of three identical modifications on three consecutive nucleotides, and where the modifications are 2'-O-methyl or 2'-fluoro modifications;
where the sense strand includes at least one phosphorothioate linkage; and
where the sense strand is conjugated to at least one ligand, optionally where the ligand is one or more C16 ligands.

An additional aspect of the instant disclosure provides a double stranded RNAi agent for inhibiting expression of an amyloid precursor protein (APP) gene, where the double stranded RNAi agent includes a sense strand and an antisense strand forming a double stranded region, where the sense strand includes at least 15 contiguous nucleotides differing by no more than 3 nucleotides from any one of the nucleotide sequences of SEQ ID NOs: 1-14 and the antisense strand includes at least 15 contiguous nucleotides differing by no more than 3 nucleotides from any one of the nucleotide sequences of SEQ ID NOs: 15-28, where substantially all of the nucleotides of the sense strand include a modification that is a 2'-O-methyl modification, a GNA and/or a 2'-fluoro modification, where the sense strand includes two phosphorothioate internucleotide linkages at the 5'-terminus, where substantially all of the nucleotides of the antisense strand include a modification selected from the group consisting of a 2'-O-methyl modification and a 2'-fluoro modification, where the antisense strand includes two phosphorothioate internucleotide linkages at the 5'-terminus and two phosphorothioate internucleotide linkages at the 3'-terminus, and where the sense strand is conjugated to one or more C16 ligands.

Another aspect of the instant disclosure provides a double stranded RNAi agent for inhibiting expression of an amyloid precursor protein (APP) gene, where the double stranded RNAi agent includes a sense strand and an antisense strand forming a double stranded region, where the sense strand includes at least 15 contiguous nucleotides differing by no more than 3 nucleotides from any one of the nucleotide sequences of SEQ ID NOs: 1-14 and the antisense strand includes at least 15 contiguous nucleotides differing by no more than 3 nucleotides from any one of the nucleotide sequences of SEQ ID NOs: 15-28, where the sense strand includes at least one 3'-terminal deoxy-thymine nucleotide (dT), and where the antisense strand includes at least one 3'-terminal deoxy-thymine nucleotide (dT).

In one embodiment, all of the nucleotides of the sense strand and all of the nucleotides of the antisense strand are modified nucleotides.

In another embodiment, each strand has 19-30 nucleotides.

In certain embodiments, the antisense strand of the RNAi agent includes at least one thermally destabilizing modification of the duplex within the first 9 nucleotide positions of the 5' region or a precursor thereof. Optionally, the thermally destabilizing modification of the duplex is one or more of

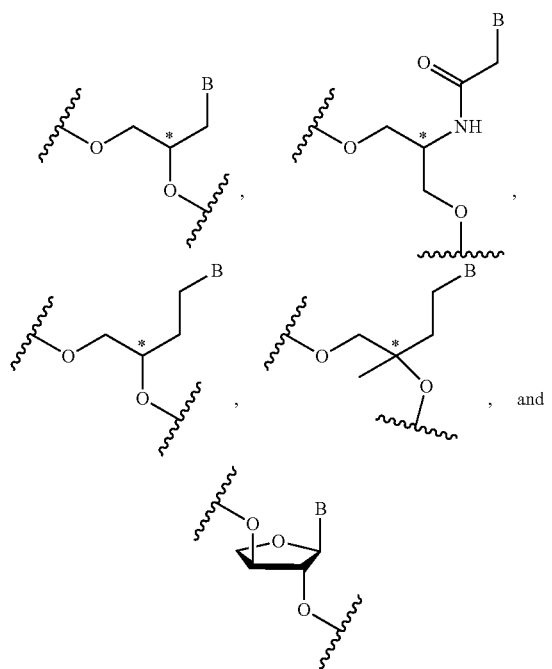

where B is nucleobase.

Another aspect of the instant disclosure provides a cell containing a double stranded RNAi agent of the instant disclosure.

An additional aspect of the instant disclosure provides a pharmaceutical composition for inhibiting expression of an APP gene that includes a double stranded RNAi agent of the instant disclosure.

In one embodiment, the double stranded RNAi agent is administered in an unbuffered solution. Optionally, the unbuffered solution is saline or water.

In another embodiment, the double stranded RNAi agent is administered with a buffer solution. Optionally, the buffer solution includes acetate, citrate, prolamine, carbonate, or phosphate or any combination thereof. In another embodiment, the buffer solution is phosphate buffered saline (PBS).

Another aspect of the disclosure provides a pharmaceutical composition that includes a double stranded RNAi agent of the instant disclosure and a lipid formulation.

In one embodiment, the lipid formulation includes a LNP.

An additional aspect of the disclosure provides a method of inhibiting expression of an amyloid precursor protein (APP) gene in a cell, the method involving: (a) contacting the cell with a double stranded RNAi agent of the instant disclosure or a pharmaceutical composition of of the instant disclosure; and (b) maintaining the cell produced in step (a) for a time sufficient to obtain degradation of the mRNA transcript of an APP gene, thereby inhibiting expression of the APP gene in the cell.

In one embodiment, the cell is within a subject. Optionally, the subject is a human.

In certain embodiments, the subject is a rhesus monkey, a cynomolgous monkey, a mouse, or a rat.

In one embodiment, the human subject suffers from an APP-associated disorder. Optionally, the APP-associated disease is cerebral amyloid angiopathy (CAA).

In another embodiment, the APP-associated disorder is early onset familial Alzheimer disease (EOFAD). In an additional embodiment, the APP-associated disorder is Alzheimer's disease (AD).

In certain embodiments APP expression is inhibited by at least about 30% by the RNAi agent.

Another aspect of the disclosure provides a method of treating a subject having a disorder that would benefit from a reduction in APP expression, the method involving administering to the subject a therapeutically effective amount of a double stranded RNAi agent of the disclosure or a pharmaceutical composition of the disclosure, thereby treating the subject.

In certain embodiments, the method further involves administering an additional therapeutic agent to the subject.

In certain embodiments, the double stranded RNAi agent is administered at a dose of about 0.01 mg/kg to about 50 mg/kg.

In some embodiments, the double stranded RNAi agent is administered to the subject intrathecally.

In certain embodiments, the administration of the double stranded RNAi to the subject causes a decrease in Aβ accumulation. Optionally, the administration of the double stranded RNAi to the subject causes a decrease in Aβ(1-40) and/or Aβ(1-42) accumulation.

In related embodiments, the administration of the dsRNA to the subject causes a decrease in amyloid plaque formation and/or accumulation in the subject.

In one embodiment, the method reduces the expression of a target gene in a brain or spine tissue. Optionally, the brain or spine tissue is cortex, cerebellum, striatum, cervical spine, lumbar spine, and/or thoracic spine.

Another aspect of the instant disclosure provides a method of inhibiting the expression of APP in a subject, the method involving: administering to the subject a therapeutically effective amount of a double stranded RNAi agent of the disclosure or a pharmaceutical composition of the disclosure, thereby inhibiting the expression of APP in the subject.

An additional aspect of the disclosure provides a method for treating or preventing an APP-associated disease or disorder in a subject, the method involving administering to the subject a therapeutically effective amount of a double stranded RNAi agent of the disclosure or a pharmaceutical composition of the disclosure, thereby treating or preventing an APP-associated disease or disorder in the subject.

In certain embodiments, the APP-associated disease or disorder is cerebral amyloid angiopathy (CAA) and/or Alzheimer's disease (AD). Optionally, the AD is early onset familial Alzheimer disease (EOFAD).

Another aspect of the instant disclosure provides a kit for performing a method of the instant disclosure, the kit including: a) a double stranded RNAi agent of the instant disclosure, and b) instructions for use, and c) optionally, a means for administering the double stranded RNAi agent to the subject.

An additional aspect of the instant disclosure provides a double stranded ribonucleic acid (RNAi) agent for inhibiting expression of an amyloid precursor protein (APP) gene, where the RNAi agent possesses a sense strand and an antisense strand, and where the antisense strand includes a region of complementarity which includes at least 15 contiguous nucleotides differing by no more than 3 nucleotides from any one of the antisense strand nucleobase sequences of AD-392911, AD-392912, AD-392816, AD-392704, AD-392843, AD-392855, AD-392840, AD-392835, AD-392729, AD-392916, AD-392876, AD-392863, AD-392917, AD-392783, AD-392765, AD-392791, AD-392800, AD-392711, AD-392801, AD-392826, AD-392818, AD-392792, AD-392802, AD-392766, AD-392767, AD-392834, AD-392974, AD-392784, AD-392744, AD-392752, AD-392737, AD-392918, AD-392919, AD-392803, AD-392804, AD-392827, AD-392828, AD-392785, AD-392829, AD-392920, AD-392921, AD-392768, AD-392805, AD-392769, AD-392753, AD-392714, AD-392703, AD-392715, AD-392836, AD-392966, AD-392832, AD-392972, AD-392961, AD-392967, AD-392894, AD-392864, AD-392865, AD-392922, AD-392833, AD-392968, AD-392962, AD-392963, AD-392969, AD-392973, AD-392923, AD-392866, AD-392877, AD-392707, AD-392926, AD-392927, AD-392717, AD-392700, AD-392878, AD-392718, AD-392929, AD-392819, AD-392745, AD-392770, AD-392806, AD-392771, AD-392820, AD-392821, AD-392786, AD-392772, AD-392699, AD-392868, AD-392719, AD-392880, AD-392930, AD-392932, AD-392869, AD-392870, AD-392896, AD-392720, AD-392746, AD-392773, AD-392807, AD-392730, AD-392721, AD-392933, AD-392881, AD-392897, AD-392898, AD-392899, AD-392935, AD-392882, AD-392738, AD-392739, AD-392936, AD-392900, AD-392901, AD-392937, AD-392883, AD-392975, AD-392938, AD-392902, AD-392941, AD-392942, AD-392943, AD-392944, AD-392903, AD-392775, AD-392758, AD-392945, AD-392884, AD-392947, AD-392748, AD-392759, AD-392837, AD-392970, AD-392976, AD-392965, AD-392831, AD-392904, AD-392885, AD-392886, AD-392776, AD-392887, AD-392722, AD-392760, AD-392731, AD-392709, AD-392723, AD-392948, AD-392724, AD-392949, AD-392725, AD-392950, AD-392732, AD-392726, AD-392862, AD-392951, AD-392871, AD-392872, AD-397183, AD-397175, AD-397177, AD-397176, AD-397260, AD-397266, AD-397267, AD-397178, AD-397180, AD-397184, AD-397179, AD-397224, AD-397225, AD-397203, AD-397185, AD-397195, AD-397204, AD-397191, AD-397251, AD-397240, AD-397205, AD-397254, AD-397259, AD-397247, AD-397233, AD-397181, AD-397196, AD-397197, AD-397226, AD-397212, AD-397182, AD-397227, AD-397217, AD-397213, AD-397229, AD-397264, AD-397265, AD-397209, AD-397192, AD-397210, AD-397219, AD-397214, AD-397220, AD-397230, AD-397231, AD-397193, AD-397190, AD-397200, AD-397248, AD-397207, AD-397211, AD-397243, AD-397246, AD-397223, AD-397202, AD-397256, AD-397257, AD-397258, AD-397250, AD-397244 AD-454972, AD-454973, AD-454842, AD-454843, AD-454844, AD-994379, AD-961583, AD-961584, AD-961585, or AD-961586.

In one embodiment, the RNAi agent includes one or more of the following modifications: a 2'-O-methyl modified nucleotide, a 2'-fluoro modified nucleotide, a 2'-C-alkyl-modified nucleotide, a nucleotide comprising a glycol nucleic acid (GNA), a phosphorothioate (PS) and a vinyl phosphonate (VP). Optionally, the RNAi agent includes at least one of each of the following modifications: a 2'-O-methyl modified nucleotide, a 2'-fluoro modified nucleotide, a 2'-C-alkyl-modified nucleotide, a nucleotide comprising a glycol nucleic acid (GNA), a phosphorothioate and a vinyl phosphonate (VP).

In another embodiment, the RNAi agent includes four or more PS modifications, optionally six to ten PS modifications, optionally eight PS modifications.

In an additional embodiment, each of the sense strand and the antisense strand of the RNAi agent possesses a 5'-terminus and a 3'-terminus, and the RNAi agent includes eight PS modifications positioned at each of the penultimate and ultimate internucleotide linkages from the respective 3'- and 5'-termini of each of the sense and antisense strands of the RNAi agent.

In another embodiment, each of the sense strand and the antisense strand of the RNAi agent includes a 5'-terminus and a 3'-terminus, and the RNAi agent includes only one nucleotide including a GNA. Optionally, the nucleotide including a GNA is positioned on the antisense strand at the seventh nucleobase residue from the 5'-terminus of the antisense strand.

In an additional embodiment, each of the sense strand and the antisense strand of the RNAi agent includes a 5'-terminus and a 3'-terminus, and the RNAi agent includes between one and four 2'-C-alkyl-modified nucleotides. Optionally, the 2'-C-alkyl-modified nucleotide is a 2'-C16-modified nucleotide. Optionally, the RNAi agent includes a single 2'-C16-modified nucleotide. Optionally, the single 2'-C16-modified nucleotide is located on the sense strand at the sixth nucleobase position from the 5'-terminus of the sense strand or on the terminal nucleobase position of the 5' end.

In another embodiment, each of the sense strand and the antisense strand of the RNAi agent includes a 5'-terminus and a 3'-terminus, and the RNAi agent includes two or more 2'-fluoro modified nucleotides. Optionally, each of the sense strand and the antisense strand of the RNAi agent includes two or more 2'-fluoro modified nucleotides. Optionally, the 2'-fluoro modified nucleotides are located on the sense strand at nucleobase positions 7, 9, 10 and 11 from the 5'-terminus of the sense strand and on the antisense strand at nucleobase positions 2, 14 and 16 from the 5'-terminus of the antisense strand.

In an additional embodiment, each of the sense strand and the antisense strand of the RNAi agent includes a 5'-terminus and a 3'-terminus, and the RNAi agent includes one or more VP modifications. Optionally, the RNAi agent includes a single VP modification at the 5'-terminus of the antisense strand.

In another embodiment, each of the sense strand and the antisense strand of the RNAi agent includes a 5'-terminus and a 3'-terminus, and the RNAi agent includes two or more 2'-O-methyl modified nucleotides. Optionally, the RNAi agent includes 2'-O-methyl modified nucleotides at all nucleobase locations not modified by a 2'-fluoro, a 2'-C-alkyl or a glycol nucleic acid (GNA). Optionally, the two or more 2'-O-methyl modified nucleotides are located on the sense strand at positions 1, 2, 3, 4, 5, 8, 12, 13, 14, 15, 16, 17, 18, 19, 20 and 21 from the 5'-terminus of the sense strand and on the antisense strand at positions 1, 3, 4, 5, 6, 8, 9, 10, 11, 12, 13, 15, 17, 18, 19, 20, 21, 22 and 23 from the 5'-terminus of the antisense strand.

Another aspect of the instant disclosure provides a double stranded ribonucleic acid (RNAi) agent for inhibiting expression of an amyloid precursor protein (APP) gene, where the RNAi agent includes a sense strand and an antisense strand, and where the antisense strand includes a region of at least 15 contiguous nucleobases in length that is sufficiently complementary to a target APP sequence of APP NM 00484 positions 1891-1919; APP NM_00484 positions 2282-2306; APP NM_00484 positions 2464-2494; APP NM_00484 positions 2475-2638; APP NM_00484 positions 2621-2689; APP NM_00484 positions 2682-2725; APP NM_00484 positions 2705-2746; APP NM_00484 positions 2726-2771; APP NM_00484 positions 2754-2788; APP NM_00484 positions 2782-2813; APP NM_00484 positions 2801-2826; APP NM_00484 positions 2847-2890; APP NM_00484 positions 2871-2896; APP NM_00484 positions 2882-2960; APP NM_00484 positions 2942-2971; APP NM_00484 positions 2951-3057; APP NM_00484 positions 3172-3223; APP NM_00484 positions 3209-3235; NM_00484 positions 3256-3289; NM_00484 positions 3302-3338; APP NM_00484 positions 3318-3353; APP NM_00484 positions 3334-3361, APP NM_001198823.1 positions 251-284; APP NM_001198823.1 positions 362-404; APP NM_001198823.1 positions 471-510; APP NM_001198823.1 positions 532-587; APP NM_001198823.1 positions 601-649; APP NM_001198823.1 positions 633-662; APP NM_001198823.1 positions 1351-1388; APP NM_001198823.1 positions 1609-1649; APP NM_001198823.1 positions 1675-1698; APP NM_001198823.1 positions 1752-1787; APP NM_001198823.1 positions 2165-2217; APP NM_001198823.1 positions 2280-2344; or APP NM_001198823.1 positions 2403-2431 to effect APP knockdown and that differs by no more than 3 nucleotides across the at least 15 contiguous nucleobases sufficiently complementary to the APP target sequence to effect APP knockdown.

Another aspect of the instant disclosure provides a double stranded RNAi agent that includes one or more modifications selected from the group consisting of a 2'-O-methyl modified nucleotide, a 2'-fluoro modified nucleotide, a 2'-C-alkyl-modified nucleotide, a nucleotide comprising a glycol nucleic acid (GNA), a phosphorothioate (PS) and a vinyl phosphonate (VP), optionally wherein said RNAi agent comprises at least one of each modification selected from the group consisting of a 2'-O-methyl modified nucleotide, a 2'-fluoro modified nucleotide, a 2'-C-alkyl-modified nucleotide, a nucleotide comprising a glycol nucleic acid (GNA), a phosphorothioate and a vinyl phosphonate (VP).

Another aspect of the instant disclosure provides that the RNAi agent comprises four or more PS modifications, optionally six to ten PS modifications, optionally eight PS modifications.

Another aspect of the instant disclosure provides that each of the sense strand and the antisense strand of the RNAi agent comprises a 5'-terminus and a 3'-terminus, and wherein the RNAi agent comprises eight PS modifications positioned at the penultimate and ultimate internucleotide linkages from the respective 3'- and 5'-termini of each of the sense and antisense strands of the RNAi agent.

Another aspect of the instant disclosure provides that each of the sense strand and the antisense strand of the RNAi agent comprises a 5'-terminus and a 3'-terminus, and wherein the RNAi agent comprises only one nucleotide comprising a GNA, optionally wherein the nucleotide comprising a GNA is positioned on the antisense strand at the seventh nucleobase residue from the 5'-terminus of the antisense strand.

Another aspect of the instant disclosure provides that each of the sense strand and the antisense strand of the RNAi agent comprises a 5'-terminus and a 3'-terminus, and wherein the RNAi agent comprises between one and four 2'-C-alkyl-modified nucleotides, optionally wherein the 2'-C-alkyl-modified nucleotide is a 2'-C16-modified nucleotide, optionally wherein the RNAi agent comprises a single 2'-C16-modified nucleotide, optionally the single 2'-C16-modified nucleotide is located on the sense strand at the sixth nucleobase position from the 5'-terminus of the sense strand or on the terminal nucleobase position of the 5' end.

Another aspect of the instant disclosure provides that each of the sense strand and the antisense strand of the RNAi agent comprises a 5'-terminus and a 3'-terminus, and wherein the RNAi agent comprises two or more 2'-fluoro modified nucleotides, optionally wherein each of the sense strand and the antisense strand of the RNAi agent comprises two or more 2'-fluoro modified nucleotides, optionally wherein the 2'-fluoro modified nucleotides are located on the sense strand at nucleobase positions 7, 9, 10 and 11 from the 5'-terminus of the sense strand and on the antisense strand at nucleobase positions 2, 14 and 16 from the 5'-terminus of the antisense strand.

Another aspect of the instant disclosure provides that each of the sense strand and the antisense strand of the RNAi agent comprises a 5'-terminus and a 3'-terminus, and wherein the RNAi agent comprises one or more VP modifications, optionally wherein the RNAi agent comprises a single VP modification at the 5'-terminus of the antisense strand.

Another aspect of the instant disclosure provides that each of the sense strand and the antisense strand of the RNAi agent comprises a 5'-terminus and a 3'-terminus, and wherein the RNAi agent comprises two or more 2'-O-methyl modified nucleotides, optionally wherein the RNAi agent comprises 2'-O-methyl modified nucleotides at all nucleobase locations not modified by a 2'-fluoro, a 2'-C-alkyl or a glycol nucleic acid (GNA), optionally wherein the two or more 2'-O-methyl modified nucleotides are located on the sense strand at positions 1, 2, 3, 4, 5, 8, 12, 13, 14, 15, 16, 17, 18, 19, 20 and 21 from the 5'-terminus of the sense strand and on the antisense strand at positions 1, 3, 4, 5, 6, 8, 9, 10, 11, 12, 13, 15, 17, 18, 19, 20, 21, 22 and 23 from the 5'-terminus of the antisense strand.

BRIEF DESCRIPTION OF THE DRAWINGS

The following detailed description, given by way of example, but not intended to limit the disclosure solely to the specific embodiments described, may best be understood in conjunction with the accompanying drawings, in which:

FIGS. 20A-20G 6 show data from in vivo screens of C16 siRNA conjugates, including the parent AD-454855, and 5 additional siRNA conjugates derived from structure activity relationship studies of AD-454855. Graphs depict the percent soluble APP alpha and beta collected from the CSF on days 8, 15, and 19 post intrathecal administration of 60 mg of each compound. FIG. 20A is a graph of soluble APP alpha and beta 4 months post dose of AD-454844 for two non-human primate subjects. FIG. 20B is a graph depicting the percent soluble APP alpha and beta collected from the CSF at Days 8, 15, and 19 post dose of AD-454844. FIG. 20C is a graph depicting the percent soluble APP alpha and beta collected from the CSF at Days 8, 15, and 19 post dose of the 5' terminal C16 siRNA conjugate, AD-994379. FIG. 20D is a graph depicting the percent soluble APP alpha and beta collected from the CSF at Days 8, 15, and 19 post dose of AD-961583. FIG. 20E is a graph depicting the percent soluble APP alpha and beta collected from the CSF at Days 8, 15, and 19 post dose of AD-961584. FIG. 20F is a graph depicting the percent soluble APP alpha and beta collected from the CSF at Days 8, 15, and 19 post dose of AD-961585. FIG. 20G is a graph depicting the percent soluble APP alpha and beta collected from the CSF at Days 8, 15, and 19 post dose of AD-961586.

FIG. 21A is a schematic of the parent internal C16 RNAi agent AD-454844 (sense strand SEQ ID NO:1880; antisense strand SEQ ID NO:1882) and the 5' terminal C16 siRNA agent AD-994379 (sense strand SEQ ID NO:2893; antisense strand SEQ ID NO:2894). FIG. 21B is a schematic of RNAi agents AD-961583 (sense strand SEQ ID NO:2895; antisense strand SEQ ID NO:2896), AD-961584 (sense strand SEQ ID NO:2897; antisense strand SEQ ID NO:2898), AD-961585 (sense strand SEQ ID NO:2899; antisense strand SEQ ID NO:2900), and AD-961586(sense strand SEQ ID NO:2901; antisense strand SEQ ID NO:2902).

DETAILED DESCRIPTION OF THE INVENTION

Figure 1A:
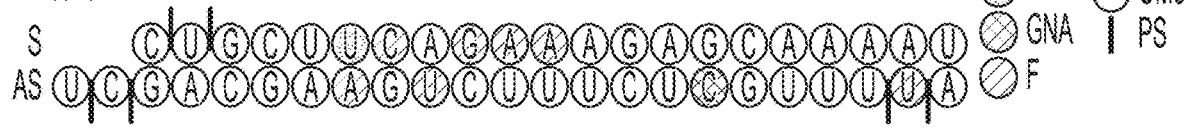
FIG. 1A and FIG. 1B show a schematic image of modified RNAi agents tested for in vivo hsAPP knockdown activity. The tested agents include AD-392911 (sense strand SEQ ID NO:867, antisense strand SEQ ID NO:868), AD-392912 (sense strand SEQ ID NO:869; antisense strand SEQ ID NO:870), AD-392913 (sense strand SEQ ID NO:949; antisense strand SEQ ID NO:950), AD-392843 (sense strand SEQ ID NO:987; antisense strand SEQ ID NO:988), AD-392844 (sense strand SEQ ID NO:919; antisense strand SEQ ID NO:920), AD-392824 (sense strand SEQ ID NO:943; antisense strand SEQ ID NO:944), AD-392704 (sense strand SEQ ID NO:967; antisense strand SEQ ID NO:968), AD-392790 (sense strand SEQ ID NO:931; antisense strand SEQ ID NO:932), AD-392703 (sense strand SEQ ID NO:1079; antisense strand SEQ ID NO:1080), AD-392866 (sense strand SEQ ID NO:1087; antisense strand SEQ ID NO:1088), AD-392927 (sense strand SEQ ID NO:1141; antisense strand SEQ ID NO:1142), AD-392916 (sense strand SEQ ID NO:997; antisense strand SEQ ID NO:998), AD-392714 (sense strand SEQ ID NO:1077; antisense strand SEQ ID NO:1078), and AD-392926 (sense strand SEQ ID NO:1139; antisense strand SEQ ID NO:1140).
Figure 1A:
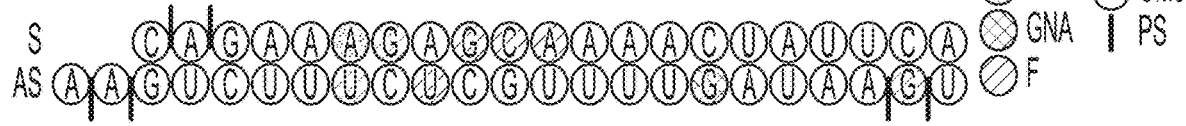
Figure 1A:
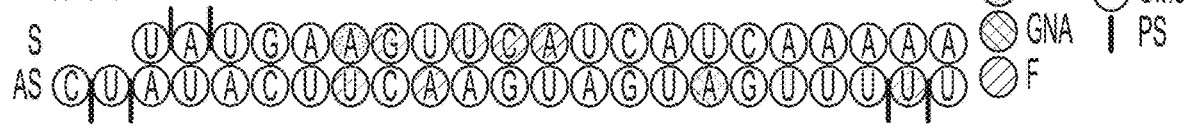
Figure 1A:
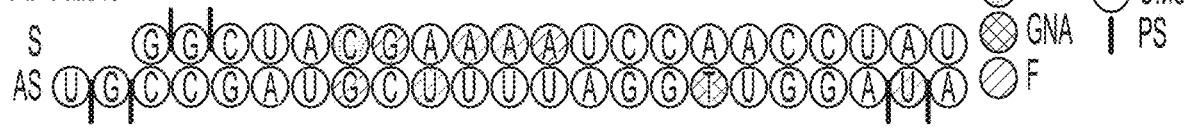
Figure 1A:
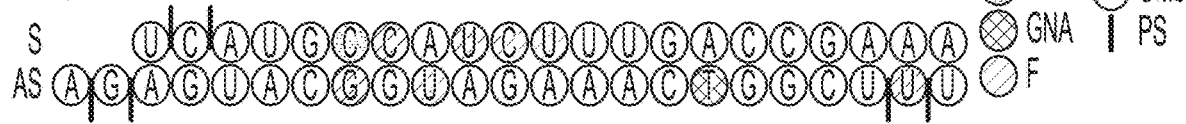
Figure 1A:
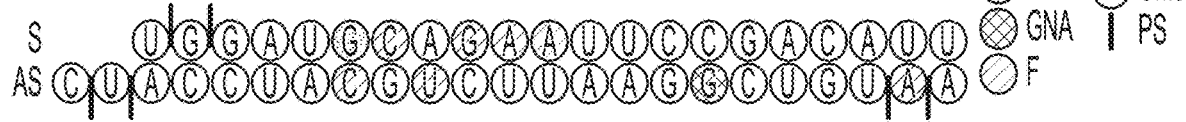
Figure 1A:
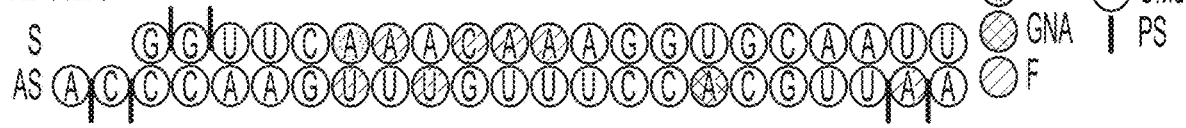
Figure 1A:
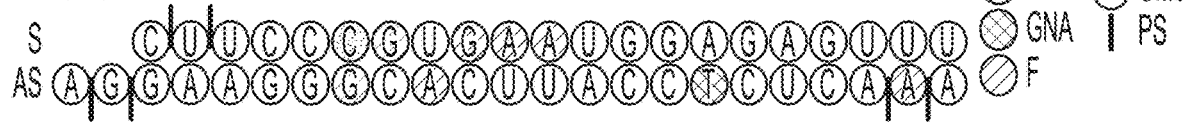

The present disclosure provides RNAi compositions, which effect the RNA-induced silencing complex (RISC)-mediated cleavage of RNA transcripts of an amyloid precursor protein (APP) gene. The APP gene may be within a cell, e.g., a cell within a subject, such as a human. The present disclosure also provides methods of using the RNAi compositions of the disclosure for inhibiting the expression of an APP gene and/or for treating a subject having a disorder that would benefit from inhibiting or reducing the expression of an APP gene, e.g., an APP-associated disease, for example, cerebral amyloid angiopathy (CAA) or Alzheimer's disease (AD), e.g., early onset familial Alzheimer disease (EOFAD).

The RNAi agents of the disclosure include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of an APP gene.

In certain embodiments, the RNAi agents of the disclosure include an RNA strand (the antisense strand) which can include longer lengths, for example up to 66 nucleotides, e.g., 36-66, 26-36, 25-36, 31-60, 22-43, 27-53 nucleotides in length with a region of at least 19 contiguous nucleotides that is substantially complementary to at least a part of an mRNA transcript of an APP gene. These RNAi agents with the longer length antisense strands preferably include a second RNA strand (the sense strand) of 20-60 nucleotides in length wherein the sense and antisense strands form a duplex of 18-30 contiguous nucleotides.

The use of these RNAi agents enables the targeted degradation of mRNAs of an APP gene in mammals. Very low dosages of APP RNAi agents, in particular, can specifically and efficiently mediate RNA interference (RNAi), resulting in significant inhibition of expression of an APP gene. Using cell-based assays, the present inventors have demonstrated that RNAi agents targeting APP can mediate RNAi, resulting in significant inhibition of expression of an APP gene. Thus, methods and compositions including these RNAi agents are useful for treating a subject who would benefit by a reduction in the levels and/or activity of an APP protein, such as a subject having an APP-associated disease, for example, CAA or AD, including, e.g., EOFAD.

The following detailed description discloses how to make and use compositions containing RNAi agents to inhibit the expression of an APP gene, as well as compositions and methods for treating subjects having diseases and disorders that would benefit from inhibition and/or reduction of the expression of this gene.

I. Definitions

In order that the present disclosure may be more readily understood, certain terms are first defined. In addition, it should be noted that whenever a value or range of values of a parameter are recited, it is intended that values and ranges intermediate to the recited values are also intended to be part of this disclosure.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to". The term "or" is used herein to mean, and is used interchangeably with, the term "and/or," unless context clearly indicates otherwise.

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleotides of a 21 nucleotide nucleic acid molecule" means that 18, 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or intergers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range.

The term "APP" amyloid precursor protein (APP), also known as amyloid beta precursor protein, Alzheimer disease amyloid protein and cerebral vascular amyloid peptide, among other names, having an amino acid sequence from any vertebrate or mammalian source, including, but not limited to, human, bovine, chicken, rodent, mouse, rat, porcine, ovine, primate, monkey, and guinea pig, unless specified otherwise. The term also refers to fragments and variants of native APP that maintain at least one in vivo or in vitro activity of a native APP (including, e.g., the beta-amyloid peptide(1-40), beta-amyloid peptide(1-38) and beta-amyloid peptide(1-42) forms of Aβ peptide, among others), including variants of APP fragments that maintain one or more activities of an APP fragment that are neurotoxic in character (e.g., variant forms of Aβ42 peptide that maintain neurotoxic character are expressly contemplated).

The term encompasses full-length unprocessed precursor forms of APP as well as mature forms resulting from post-translational cleavage of the signal peptide. The term also encompasses peptides that derive from APP via further cleavage, including, e.g., Aβ peptides. The nucleotide and amino acid sequence of a human APP can be found at, for example, GenBank Accession No. GI: 228008405 (NM_201414; SEQ ID NO: 1). The nucleotide and amino acid sequence of a human APP may also be found at, for example, GenBank Accession No. GI: 228008403 (NM_000484.3; SEQ ID NO: 2); GenBank Accession No. GI: 228008404 (NM_201413.2; SEQ ID NO: 3); GenBank Accession No. GI: 324021746 (NM_001136016.3; SEQ ID NO: 4); GenBank Accession No. GI: 228008402 (NM_001136129.2; SEQ ID NO: 5); GenBank Accession No. GI: 228008401 (NM_001136130.2; SEQ ID NO: 6); GenBank Accession No. GI: 324021747 (NM_001136131.2; SEQ ID NO: 7); GenBank Accession No. GI: 324021737 (NM_001204301.1; SEQ ID NO: 8); GenBank Accession No. GI: 324021735 (NM_001204302.1; SEQ ID NO: 9); and GenBank Accession No. GI: 324021739 (NM_001204303.1; SEQ ID NO: 10); and GenBank Accession No. GI: 1370481385 (XM_024452075.1; SEQ ID NO: 11).

The nucleotide and amino acid sequence of a Cynomolgus monkey APP can be found at, for example, GenBank Accession No. GI: 982237868 (XM_005548883.2; SEQ ID NO: 12). The nucleotide and amino acid sequence of a mouse APP can be found at, for example, GenBank Accession No. GI: 311893400 (NM_001198823; SEQ ID NO: 13). The nucleotide and amino acid sequence of a rat APP can be found at, for example, GenBank Accession No. GI: 402692725 (NM_019288.2; SEQ ID NO: 14). Additional examples of APP sequences are readily available using publicly available databases, e.g., GenBank, UniProt, and OMIM.

The term "APP" as used herein also refers to a particular polypeptide expressed in a cell by naturally occurring DNA sequence variations of the APP gene, such as a single nucleotide polymorphism in the APP gene. Numerous SNPs within the APP gene have been identified and may be found at, for example, NCBI dbSNP (see, e.g., www.ncbi.nlm.nih.gov/snp). Non-limiting examples of SNPs within the APP gene may be found at, NCBI dbSNP Accession Nos. rs193922916, rs145564988, rs193922916, rs214484, rs281865161, rs364048, rs466433, rs466448, rs532876832, rs63749810, rs63749964, rs63750064, rs63750066, rs63750151, rs63750264, rs63750363, rs63750399, rs63750445, rs63750579, rs63750643, rs63750671, rs63750734, rs63750847, rs63750851, rs63750868, rs63750921, rs63750973, rs63751039, rs63751122 and rs63751263. Certain exemplary rare APP variants that have been previously described to play a role in development of EOFAD were identified in Hooli et al. (*Neurology* 78: 1250-57). In addition, various "non-classical" APP variants that harbor an intraexonic junction within sequenced cDNA have recently been identified as associated with the occurrence of somatic gene recombination in the brains of AD patients (PCT/US2018/030520, which is incorporated herein by reference in its entirety). Examples of such "non-classical" APP variants include cAPP-R3/16 (SEQ ID NO: 1865), cAPP-R3/16-2 (SEQ ID NO: 1866), cAPP-R2/18 (SEQ ID NO: 1867), cAPP-R6/18 (SEQ ID NO: 1868), cAPP-R3/14 (SEQ ID NO: 1869), cAPP-R3/17 (SEQ ID NO: 1870), cAPP-R1/11 (SEQ ID NO: 1871), cAPP-R1/13 (SEQ ID NO: 1872), cAPP-R1/11-2 (SEQ ID NO: 1873), cAPP-R1/14 (SEQ ID NO: 1874), cAPP-R2/17 (SEQ ID NO: 1875), cAPP-R2/16 (SEQ ID NO: 1876), cAPP-R6/17 (SEQ ID NO: 1877), cAPP-R2/14 (SEQ ID NO: 1878), cAPP-R14/17-d8 (SEQ ID NO: 1879) and cAPP-D2/18-3 (SEQ ID NO: 1880). It is expressly contemplated that RNAi agents of the instant disclosure can be used to target "non-classical" APP variants and/or that RNAi agents optionally specific for such "non-classical" APP variants can be designed and used, optionally in combination with other RNAi agents of the instant disclosure, including those that target native forms of APP. Such "non-classical" APP variants were described as notably absent from an assayed HIV patient population, with prevalence of AD in the HIV patient population significantly diminished as compared to expected levels, which indicated that reverse transcriptase inhibitors and/or other anti-retroviral therapies commonly used to treat HIV patients likely also exerted a therapeutic/preventative role against AD. It is therefore expressly contemplated that the RNAi agents of the instant disclosure can optionally be employed in combination with reverse transcriptase inhibitors and/or other anti-retroviral therapies, for therapeutic and/or preventative purposes.

As used herein, "target sequence" refers to a contiguous portion of the nucleotide sequence of an mRNA molecule formed during the transcription of an APP gene, including mRNA that is a product of RNA processing of a primary transcription product. In one embodiment, the target portion of the sequence will be at least long enough to serve as a substrate for RNAi-directed cleavage at or near that portion of the nucleotide sequence of an mRNA molecule formed during the transcription of an APP gene.

The target sequence may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the disclosure.

As used herein, the term "strand comprising a sequence" refers to an oligonucleotide comprising a chain of nucleotides that is described by the sequence referred to using the standard nucleotide nomenclature.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, thymidine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the disclosure by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the disclosure.

The terms "iRNA", "RNAi agent," "iRNA agent," "RNA interference agent" as used interchangeably herein, refer to an agent that contains RNA as that term is defined herein, and which mediates the targeted cleavage of an RNA transcript via an RNA-induced silencing complex (RISC) pathway. RNA interference (RNAi) is a process that directs the sequence-specific degradation of mRNA. RNAi modulates, e.g., inhibits, the expression of APP in a cell, e.g., a cell within a subject, such as a mammalian subject.

In one embodiment, an RNAi agent of the disclosure includes a single stranded RNAi that interacts with a target RNA sequence, e.g., an APP target mRNA sequence, to direct the cleavage of the target RNA. Without wishing to be bound by theory it is believed that long double stranded RNA introduced into cells is broken down into double-stranded short interfering RNAs (siRNAs) comprising a sense strand and an antisense strand by a Type III endonuclease known as Dicer (Sharp et al. (2001) Genes Dev. 15:485). Dicer, a ribonuclease-III-like enzyme, processes these dsRNA into 19-23 base pair short interfering RNAs with characteristic two base 3' overhangs (Bernstein, et al., (2001) Nature 409:363). These siRNAs are then incorporated into an RNA-induced silencing complex (RISC) where one or more helicases unwind the siRNA duplex, enabling the complementary antisense strand to guide target recognition (Nykanen, et al., (2001) Cell 107:309). Upon binding to the appropriate target mRNA, one or more endonucleases within the RISC cleave the target to induce silencing (Elbashir, et al., (2001) Genes Dev. 15:188). Thus, in one aspect the disclosure relates to a single stranded RNA (ssRNA) (the antisense strand of a siRNA duplex) generated within a cell and which promotes the formation of a RISC complex to effect silencing of the target gene, i.e., an APP gene. Accordingly, the term "siRNA" is also used herein to refer to an RNAi as described above.

In another embodiment, the RNAi agent may be a single-stranded RNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded RNAs are described in U.S. Pat. No. 8,101,348 and in Lima et al., (2012) Cell 150:883-894, the entire contents of each of which are hereby incorporated herein by reference. Any of the antisense nucleotide sequences described herein may be used as a single-stranded siRNA as described herein or as chemically modified by the methods described in Lima et al., (2012) Cell 150:883-894.

In another embodiment, a "RNAi agent" for use in the compositions and methods of the disclosure is a double stranded RNA and is referred to herein as a "double stranded RNAi agent," "double stranded RNA (dsRNA) molecule," "dsRNA agent," or "dsRNA". The term "dsRNA" refers to a complex of ribonucleic acid molecules, having a duplex structure comprising two anti-parallel and substantially complementary nucleic acid strands, referred to as having "sense" and "antisense" orientations with respect to a target RNA, i.e., an APP gene. In some embodiments of the disclosure, a double stranded RNA (dsRNA) triggers the degradation of a target RNA, e.g., an mRNA, through a post-transcriptional gene-silencing mechanism referred to herein as RNA interference or RNAi.

In general, a number of nucleotides of each strand of a dsRNA molecule are ribonucleotides, but as described in detail herein, each or both strands can also include one or more non-ribonucleotides, e.g., a deoxyribonucleotide and/or a modified nucleotide. In addition, as used in this specification, an "RNAi agent" may include ribonucleotides with chemical modifications; an RNAi agent may include substantial modifications at multiple nucleotides. As used herein, the term "modified nucleotide" refers to a nucleotide having, independently, a modified sugar moiety, a modified internucleotide linkage, and/or a modified nucleobase. Thus, the term modified nucleotide encompasses substitutions, additions or removal of, e.g., a functional group or atom, to internucleoside linkages, sugar moieties, or nucleobases. The modifications suitable for use in the agents of the disclosure include all types of modifications disclosed herein or known in the art. Any such modifications, as used in a siRNA type molecule, are encompassed by "RNAi agent" for the purposes of this specification and claims.

In certain embodiments of the instant disclosure, inclusion of a deoxy-nucleotide—which is acknowledged as a naturally occurring form of nucleotide—if present within a RNAi agent can be considered to constitute a modified nucleotide.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the disclosure.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, at least 3, at least 4, at least 5, at least 6, at least 7, at least 8, at least 9, at least 10, at least 20, at least 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not, but can be covalently connected. In certain embodiments where the two strands are connected covalently by means other than an uninterrupted chain of nucleotides between the 3'-end of one strand and the 5'-end of the respective other strand forming the duplex structure, the connecting structure is referred to as a "linker" (though it is noted that certain other structures defined elsewhere herein can also be referred to as a "linker"). The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In one embodiment, an RNAi agent of the disclosure is a dsRNA, each strand of which comprises 19-23 nucleotides, that interacts with a target RNA sequence, e.g., an APP target mRNA sequence, to direct the cleavage of the target RNA. Without wishing to be bound by theory, long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107: 309). Upon binding to the appropriate target mRNA, one or more endonucleases within the RISC cleave the target to induce silencing (Elbashir, et al., (2001) *Genes Dev.* 15:188).

As used herein, the term "nucleotide overhang" refers to at least one unpaired nucleotide that protrudes from the duplex structure of a RNAi agent, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end and/or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end and/or the 5'-end. In another embodiment, one or more of the nucleotides in the overhang is replaced with a nucleoside thiophosphate.

In certain embodiments, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide, overhang at the 3'-end and/or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end and/or the 5'-end. In another embodiment, one or more of the nucleotides in the overhang is replaced with a nucleoside thiophosphate.

In certain embodiments, the overhang on the sense strand or the antisense strand, or both, can include extended lengths longer than 10 nucleotides, e.g., 1-30 nucleotides, 2-30 nucleotides, 10-30 nucleotides, or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the overhang is replaced with a nucleoside thiophosphate. In certain embodiments, the overhang includes a self-complementary portion such that the overhang is capable of forming a hairpin structure that is stable under physiological conditions.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double stranded over its entire length.

The term "antisense strand" or "guide strand" refers to the strand of a RNAi agent, e.g., a dsRNA, which includes a region that is substantially complementary to a target sequence, e.g., an APP mRNA.

As used herein, the term "region of complementarity" refers to the region on the antisense strand that is substantially complementary to a sequence, for example a target sequence, e.g., an APP nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, or 2 nucleotides of the 5'- and/or 3'-terminus of the RNAi agent.

The term "sense strand" or "passenger strand" as used herein, refers to the strand of a RNAi agent that includes a region that is substantially complementary to a region of the antisense strand as that term is defined herein.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within a RNAi agent, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs and/or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of a RNAi agent and a target sequence, as will be understood from the context of their use.

As used herein, a polynucleotide that is "substantially complementary to at least part of a messenger RNA (mRNA) refers to a polynucleotide that is substantially complementary to a contiguous portion of the mRNA of interest (e.g., an mRNA encoding APP). For example, a polynucleotide is complementary to at least a part of an APP mRNA if the sequence is substantially complementary to a non-interrupted portion of an mRNA encoding APP.

Accordingly, in some embodiments, the antisense strand polynucleotides disclosed herein are fully complementary to the target APP sequence. In other embodiments, the antisense strand polynucleotides disclosed herein are substantially complementary to the target APP sequence and comprise a contiguous nucleotide sequence which is at least about 80% complementary over its entire length to the equivalent region of the nucleotide sequence of SEQ ID NOs: 1-14, or a fragment of SEQ ID NOs: 1-14, such as about 85%, about 86%, about 87%, about 88%, about 89%, about 90%, about % 91%, about 92%, about 93%, about 94%, about 95%, about 96%, about 97%, about 98%, or about 99% complementary.

In other embodiments, the antisense polynucleotides disclosed herein are substantially complementary to the target APP sequence and comprise a contiguous nucleotide sequence which is at least about 80% complementary over its entire length to any one of the sense strand nucleotide sequences in any one of Tables 2A, 2B, 3, 5A, 5B, 6, 9, 10-15, 16A, 16B, or 26, or a fragment of any one of the sense strand nucleotide sequences in any one of Tables 2A, 2B, 3, 5A, 5B, 6, 9, 10-15, 16A, 16B, or 26, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the disclosure includes a sense strand that is substantially complementary to an antisense polynucleotide which, in turn, is the same as a target APP sequence, and wherein the sense strand polynucleotide comprises a contiguous nucleotide sequence which is at least about 80% complementary over its entire length to the equivalent region of the nucleotide sequence of SEQ ID NOs: 15-28, or a fragment of any one of SEQ ID NOs: 15-28, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, at least partial suppression of the expression of an APP gene, is assessed by a reduction of the amount of APP mRNA which can be isolated from or detected in a first cell or group of cells in which an APP gene is transcribed and which has or have been treated such that the expression of an APP gene is inhibited, as compared to a second cell or group of cells substantially identical to the first cell or group of cells but which has or have not been so treated (control cells). The degree of inhibition may be expressed in terms of:

$$\frac{(mRNA \text{ in control cells}) - (mRNA \text{ in treated cells})}{(mRNA \text{ in control cells})} \cdot 100\%$$

The phrase "contacting a cell with an RNAi agent," such as a dsRNA, as used herein, includes contacting a cell by any possible means. Contacting a cell with an RNAi agent includes contacting a cell in vitro with the RNAi agent or contacting a cell in vivo with the RNAi agent. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., the central nervous system (CNS), optionally via intrathecal, intravitreal or other injection, or to the bloodstream or the subcutaneous space, such that the agent will subsequently reach the tissue where the cell to be contacted is located. For example, the RNAi agent may contain and/or be coupled to a ligand, e.g., a lipophilic moiety or moieties as described below and further detailed, e.g., in U.S. Application Nos.

62/668,072, 62/738,747 and/or 62/773,082, that directs and/or otherwise stabilizes the RNAi agent at a site of interest, e.g., the CNS. Combinations of in vitro and in vivo methods of contacting are also possible. For example, a cell may also be contacted in vitro with an RNAi agent and subsequently transplanted into a subject.

In one embodiment, contacting a cell with a RNAi agent includes "introducing" or "delivering the RNAi agent into the cell" by facilitating or effecting uptake or absorption into the cell. Absorption or uptake of a RNAi agent can occur through unaided diffusive or active cellular processes, or by auxiliary agents or devices. Introducing a RNAi agent into a cell may be in vitro and/or in vivo. For example, for in vivo introduction, a RNAi agent can be injected into a tissue site or administered systemically. In vitro introduction into a cell includes methods known in the art such as electroporation and lipofection. Further approaches are described herein below and/or are known in the art.

The term "lipophile" or "lipophilic moiety" broadly refers to any compound or chemical moiety having an affinity for lipids. One way to characterize the lipophilicity of the lipophilic moiety is by the octanol-water partition coefficient, log $K_{ow}$, where $K_{ow}$ is the ratio of a chemical's concentration in the octanol-phase to its concentration in the aqueous phase of a two-phase system at equilibrium. The octanol-water partition coefficient is a laboratory-measured property of a substance. However, it may also be predicted by using coefficients attributed to the structural components of a chemical which are calculated using first-principle or empirical methods (see, for example, Tetko et al., *J. Chem. Inf. Comput. Sci.* 41:1407-21 (2001), which is incorporated herein by reference in its entirety). It provides a thermodynamic measure of the tendency of the substance to prefer a non-aqueous or oily milieu rather than water (i.e. its hydrophilic/lipophilic balance). In principle, a chemical substance is lipophilic in character when its log $K_{ow}$ exceeds 0. Typically, the lipophilic moiety possesses a log $K_{ow}$ exceeding 1, exceeding 1.5, exceeding 2, exceeding 3, exceeding 4, exceeding 5, or exceeding 10. For instance, the log $K_{ow}$ of 6-amino hexanol, for instance, is predicted to be approximately 0.7. Using the same method, the log $K_{ow}$ of cholesteryl N-(hexan-6-ol) carbamate is predicted to be 10.7.

The lipophilicity of a molecule can change with respect to the functional group it carries. For instance, adding a hydroxyl group or amine group to the end of a lipophilic moiety can increase or decrease the partition coefficient (e.g., log $K_{ow}$) value of the lipophilic moiety.

Alternatively, the hydrophobicity of the double-stranded RNAi agent, conjugated to one or more lipophilic moieties, can be measured by its protein binding characteristics. For instance, in certain embodiments, the unbound fraction in the plasma protein binding assay of the double-stranded RNAi agent could be determined to positively correlate to the relative hydrophobicity of the double-stranded RNAi agent, which could then positively correlate to the silencing activity of the double-stranded RNAi agent.

In one embodiment, the plasma protein binding assay determined is an electrophoretic mobility shift assay (EMSA) using human serum albumin protein. An exemplary protocol of this binding assay is illustrated in detail in, e.g., U.S. Application Nos. 62/668,072, 62/738,747 and/or 62/773,082. The hydrophobicity of the double-stranded RNAi agent, measured by fraction of unbound siRNA in the binding assay, exceeds 0.15, exceeds 0.2, exceeds 0.25, exceeds 0.3, exceeds 0.35, exceeds 0.4, exceeds 0.45, or exceeds 0.5 for an enhanced in vivo delivery of siRNA.

Accordingly, conjugating the lipophilic moieties to the internal position(s) of the double-stranded RNAi agent provides optimal hydrophobicity for the enhanced in vivo delivery of siRNA.

The term "lipid nanoparticle" or "LNP" is a vesicle comprising a lipid layer encapsulating a pharmaceutically active molecule, such as a nucleic acid molecule, e.g., a rNAi agent or a plasmid from which a RNAi agent is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a camel, a llama, a horse, a goat, a rabbit, a sheep, a hamster, a guinea pig, a cat, a dog, a rat, a mouse, a horse, and a whale), or a bird (e.g., a duck or a goose). In an embodiment, the subject is a human, such as a human being treated or assessed for a disease, disorder or condition that would benefit from reduction in APP expression; a human at risk for a disease, disorder or condition that would benefit from reduction in APP expression; a human having a disease, disorder or condition that would benefit from reduction in APP expression; and/or human being treated for a disease, disorder or condition that would benefit from reduction in APP expression as described herein.

As used herein, the terms "treating" or "treatment" refer to a beneficial or desired result including, but not limited to, alleviation or amelioration of one or more symptoms associated with APP gene expression and/or APP protein production, e.g., APP-associated diseases or disorders such as AD, CAA (e.g., hereditary CAA) and EOFAD, among others. "Treatment" can also mean prolonging survival as compared to expected survival in the absence of treatment.

The term "lower" in the context of the level of APP in a subject or a disease marker or symptom refers to a statistically significant decrease in such level. The decrease can be, for example, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more. In certain embodiments, a decrease is at least 20%. "Lower" in the context of the level of APP in a subject is preferably down to a level accepted as within the range of normal for an individual without such disorder.

As used herein, "prevention" or "preventing," when used in reference to a disease, disorder or condition thereof, that would benefit from a reduction in expression of an APP gene and/or production of APP protein, refers to a reduction in the likelihood that a subject will develop a symptom associated with such a disease, disorder, or condition, e.g., a symptom of APP gene expression, such as the presence of various forms of AP (e.g., A1338, Aβ40 and/or Aβ42, etc.), amyloid plaques and/or cerebral amyloid angiopathy (CAA) or Alzheimer's disease (AD), including, e.g., early onset familial Alzheimer disease (EOFAD). The failure to develop a disease, disorder or condition, or the reduction in the development of a symptom associated with such a disease, disorder or condition (e.g., by at least about 10% on a clinically accepted scale for that disease or disorder), or the exhibition of delayed symptoms delayed (e.g., by days, weeks, months or years) is considered effective prevention.

As used herein, the term "APP-associated disease," is a disease or disorder that is caused by, or associated with APP gene expression or APP protein production. The term "APP-associated disease" includes a disease, disorder or condition that would benefit from a decrease in APP gene expression, replication, or protein activity. Non-limiting examples of APP-associated diseases include, for example, cerebral amyloid angiopathy (CAA) and Alzheimer's disease (AD), including, e.g., early onset familial Alzheimer disease (EO-FAD).

"Therapeutically effective amount," as used herein, is intended to include the amount of an RNAi agent that, when administered to a subject having an APP-associated disorder, is sufficient to effect treatment of the disease (e.g., by diminishing, ameliorating or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of a RNAi agent that, when administered to a subject having an APP-associated disorder, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylacticaly effective amount" also includes an amount of a RNAi agent that produces some desired local or systemic effect at a reasonable benefit/risk ratio applicable to any treatment. A RNAi agent employed in the methods of the present disclosure may be administered in a sufficient amount to produce a reasonable benefit/risk ratio applicable to such treatment.

The phrase "pharmaceutically acceptable" is employed herein to refer to those compounds, materials, compositions, and/or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; and (22) other non-toxic compatible substances employed in pharmaceutical formulations.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the brain (e.g., whole brain or certain segments of brain or certain types of cells in the brain, such as, e.g., neurons and glial cells (astrocytes, oligodendrocytes, microglial cells)). In some embodiments, a "sample derived from a subject" refers to blood or plasma drawn from the subject. In further embodiments, a "sample derived from a subject" refers to brain tissue (or subcomponents thereof) or retinal tissue (or subcomponents thereof) derived from the subject.

II. RNAi Agents of the Disclosure

Described herein are RNAi agents which inhibit the expression of an APP gene. In one embodiment, the RNAi agent includes double stranded ribonucleic acid (dsRNA) molecules for inhibiting the expression of an APP gene in a cell, such as a cell within a subject, e.g., a mammal, such as a human having an APP-associated disorder, e.g., cerebral amyloid angiopathy (CAA) or Alzheimer's disease (AD), including, e.g., early onset familial Alzheimer disease (EO-FAD). The dsRNA includes an antisense strand having a region of complementarity which is complementary to at least a part of an mRNA formed in the expression of an APP gene, The region of complementarity is about 30 nucleotides or less in length (e.g., about 30, 29, 28, 27, 26, 25, 24, 23, 22, 21, 20, 19, or 18 nucleotides or less in length). Upon contact with a cell expressing the APP gene, the RNAi agent inhibits the expression of the APP gene (e.g., a human, a primate, a non-primate, or a bird APP gene) by at least about 10% as assayed by, for example, a PCR or branched DNA (bDNA)-based method, or by a protein-based method, such as by immunofluorescence analysis, using, for example, Western Blotting or flowcytometric techniques.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an APP gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is between 15 and 30 base pairs in length, e.g., between, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain preferred embodiments, the duplex structure is between 18 and 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length. Ranges and lengths intermediate to the above recited ranges and lengths are also contemplated to be part of the disclosure.

Similarly, the region of complementarity to the target sequence is between 15 and 30 nucleotides in length, e.g., between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the disclosure.

In some embodiments, the dsRNA is between about 15 and about 23 nucleotides in length, or between about 25 and about 30 nucleotides in length. In general, the dsRNA is long enough to serve as a substrate for the Dicer enzyme. For example, it is well known in the art that dsRNAs longer than about 21-23 nucleotides can serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to 36 base pairs, e.g., about 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, a RNAi agent useful to target APP expression is not generated in the target cell by cleavage of a larger dsRNA.

A dsRNA as described herein can further include one or more single-stranded nucleotide overhangs e.g., 1, 2, 3, or 4 nucleotides. dsRNAs having at least one nucleotide overhang can have unexpectedly superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

A dsRNA can be synthesized by standard methods known in the art as further discussed below, e.g., by use of an automated DNA synthesizer, such as are commercially available from, for example, Biosearch, Applied Biosystems, Inc.

RNAi agents of the disclosure may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Single-stranded oligonucleotides of the disclosure can be prepared using solution-phase or solid-phase organic synthesis or both.

In one aspect, a dsRNA of the disclosure includes at least two nucleotide sequences, a sense sequence and an antisense sequence. The sense strand sequence may be selected from the group of sequences provided in any one of Tables 2A, 2B, 3, 5A, 5B, 6, 9, 10-15, 16A, 16B, and 26 and the corresponding nucleotide sequence of the antisense strand of the sense strand may be selected from the group of sequences of any one of Tables 2A, 2B, 3, 5A, 5B, 6, 9, 10-15, 16A, 16B, and 26. In this aspect, one of the two sequences is complementary to the other of the two sequences, with one of the sequences being substantially complementary to a sequence of an mRNA generated in the expression of an APP gene. As such, in this aspect, a dsRNA will include two oligonucleotides, where one oligonucleotide is described as the sense strand (passenger strand) in any one of Tables 2A, 2B, 3, 5A, 5B, 6, 9, 10-15, 16A, 16B, and 26, and the second oligonucleotide is described as the corresponding antisense strand (guide strand) of the sense strand in any one of Tables 2A, 2B, 3, 5A, 5B, 6, 9, 10-15, 16A, 16B, and 26. Accordingly, by way of example, the following pairwise selections of sense and antisense strand sequences of Table 3 are expressly contemplated as forming duplexes of the instant disclosure: SEQ ID NOs: 855 and 856; SEQ ID NOs: 857 and 858; SEQ ID NOs: 859 and 860; SEQ ID NOs: 861 and 862; SEQ ID NOs: 863 and 864; SEQ ID NOs: 865 and 866; SEQ ID NOs: 867 and 868; SEQ ID NOs: 869 and 870; SEQ ID NOs: 871 and 872; SEQ ID NOs: 873 and 874; SEQ ID NOs: 875 and 876; SEQ ID NOs: 877 and 878; SEQ ID NOs: 879 and 880; SEQ ID NOs: 881 and 882; SEQ ID NOs: 883 and 884; SEQ ID NOs: 885 and 886; SEQ ID NOs: 887 and 888; SEQ ID NOs: 889 and 890; SEQ ID NOs: 891 and 892; SEQ ID NOs: 893 and 894; SEQ ID NOs: 895 and 896; SEQ ID NOs: 897 and 898; SEQ ID NOs: 899 and 900; SEQ ID NOs: 901 and 902; SEQ ID NOs: 903 and 904; SEQ ID NOs: 905 and 906; SEQ ID NOs: 907 and 908; SEQ ID NOs: 909 and 910; SEQ ID NOs: 911 and 912; SEQ ID NOs: 913 and 914; SEQ ID NOs: 915 and 916; SEQ ID NOs: 917 and 918; SEQ ID NOs: 919 and 920; SEQ ID NOs: 921 and 922; SEQ ID NOs: 923 and 924; SEQ ID NOs: 925 and 926; SEQ ID NOs: 927 and 928; SEQ ID NOs: 929 and 930; SEQ ID NOs: 931 and 932; SEQ ID NOs: 933 and 934; SEQ ID NOs: 935 and 936; SEQ ID NOs: 937 and 938; SEQ ID NOs: 939 and 940; SEQ ID NOs: 941 and 942; SEQ ID NOs: 943 and 944; SEQ ID NOs: 945 and 946; SEQ ID NOs: 947 and 948; SEQ ID NOs: 949 and 950; SEQ ID NOs: 951 and 952; SEQ ID NOs: 953 and 954; SEQ ID NOs: 955 and 956; SEQ ID NOs: 957 and 958; SEQ ID NOs: 959 and 960; SEQ ID NOs: 961 and 962; SEQ ID NOs: 963 and 964; SEQ ID NOs: 965 and 966; SEQ ID NOs: 967 and 968; SEQ ID NOs: 969 and 970; SEQ ID NOs: 971 and 972; SEQ ID NOs: 973 and 974; SEQ ID NOs: 975 and 976; SEQ ID NOs: 977 and 978; SEQ ID NOs: 979 and 980; SEQ ID NOs: 981 and 982; SEQ ID NOs: 983 and 984; SEQ ID NOs: 985 and 986; SEQ ID NOs: 987 and 988; SEQ ID NOs: 989 and 990; SEQ ID NOs: 991 and 992; SEQ ID NOs: 993 and 994; SEQ ID NOs: 995 and 996; SEQ ID NOs: 997 and 998; SEQ ID NOs: 999 and 1000; SEQ ID NOs: 1001 and 1002; SEQ ID NOs: 1003 and 1004; SEQ ID NOs: 1005 and 1006; SEQ ID NOs: 1007 and 1008; SEQ ID NOs: 1009 and 1010; SEQ ID NOs: 1011 and 1012; SEQ ID NOs: 1013 and 1014; SEQ ID NOs: 1015 and 1016; SEQ ID NOs: 1017 and 1018; SEQ ID NOs: 1019 and 1020; SEQ ID NOs: 1021 and 1022; SEQ ID NOs: 1023 and 1024; SEQ ID NOs: 1025 and 1026; SEQ ID NOs: 1027 and 1028; SEQ ID NOs: 1029 and 1030; SEQ ID NOs: 1031 and 1032; SEQ ID NOs: 1033 and 1034; SEQ ID NOs: 1035 and 1036; SEQ ID NOs: 1037 and 1038; SEQ ID NOs: 1039 and 1040; SEQ ID NOs: 1041 and 1042; SEQ ID NOs: 1043 and 1044; SEQ ID NOs: 1045 and 1046; SEQ ID NOs: 1047 and 1048; SEQ ID NOs: 1049 and 1050; SEQ ID NOs: 1051 and 1052; SEQ ID NOs: 1053 and 1054; SEQ ID NOs: 1055 and 1056; SEQ ID NOs: 1057 and 1058; SEQ ID NOs: 1059 and 1060; SEQ ID NOs: 1061 and 1062; SEQ ID NOs: 1063 and 1064; SEQ ID NOs: 1065 and 1066; SEQ ID NOs: 1067 and 1068; SEQ ID NOs: 1069 and 1070; SEQ ID NOs: 1071 and 1072; SEQ ID NOs: 1073 and 1074; SEQ ID NOs: 1075 and 1076; SEQ ID NOs: 1077 and 1078; SEQ ID NOs: 1079 and 1080; SEQ ID NOs: 1081 and 1082; SEQ ID NOs: 1083 and 1084; SEQ ID NOs: 1085 and 1086; SEQ ID NOs: 1087 and 1088; SEQ ID NOs: 1089 and 1090; SEQ ID NOs: 1091 and 1092; SEQ ID NOs: 1093 and 1094; SEQ ID NOs: 1095 and 1096; SEQ ID NOs: 1097 and 1098; SEQ ID NOs: 1099 and 1100; SEQ ID NOs: 1101 and 1102; SEQ ID NOs: 1103 and 1104; SEQ ID NOs: 1105 and 1106; SEQ ID NOs: 1107 and 1108; SEQ ID NOs: 1109 and 1110; SEQ ID NOs: 1111 and 1112; SEQ ID NOs: 1113 and 1114; SEQ ID NOs: 1115 and 1116; SEQ ID NOs: 1117 and 1118; SEQ ID NOs: 1119 and 1120; SEQ ID NOs: 1121 and 1122; SEQ ID NOs: 1123 and 1124; SEQ ID NOs: 1125 and 1126; SEQ ID NOs: 1127 and 1128; SEQ ID NOs: 1129 and 1130; SEQ ID NOs: 1131 and 1132; SEQ ID NOs: 1133 and 1134; SEQ ID NOs: 1135 and 1136; SEQ ID NOs: 1137 and 1138; SEQ ID NOs: 1139 and 1140; SEQ ID NOs: 1141 and 1142; SEQ ID NOs: 1143 and 1144; SEQ ID NOs: 1145 and 1146; SEQ ID NOs: 1147 and 1148; SEQ ID NOs: 1149 and 1150; SEQ ID NOs: 1151 and 1152; SEQ ID NOs: 1153 and 1154; SEQ ID NOs: 1155 and 1156; SEQ ID NOs: 1157 and 1158; SEQ ID NOs: 1159 and 1160; SEQ ID NOs: 1161 and 1162; SEQ ID NOs: 1163 and 1164; SEQ ID NOs: 1165 and 1166; SEQ ID NOs: 1167 and 1168; SEQ ID NOs: 1169 and 1170; SEQ ID NOs: 1171 and 1172; SEQ ID NOs: 1173 and 1174; SEQ ID NOs: 1175 and 1176; SEQ ID NOs: 1177 and 1178; SEQ ID NOs: 1179 and 1180; SEQ ID NOs: 1181 and 1182; SEQ ID NOs: 1183 and 1184; SEQ ID NOs: 1185 and 1186; SEQ ID NOs: 1187 and 1188; SEQ ID NOs: 1189 and 1190; SEQ ID NOs: 1191 and 1192; SEQ ID NOs: 1193 and 1194; SEQ ID NOs: 1195 and 1196; SEQ ID NOs: 1197 and 1198; SEQ ID NOs: 1199 and 1200; SEQ ID NOs: 1201 and 1202; SEQ ID NOs: 1203 and 1204; SEQ ID NOs: 1205 and 1206; SEQ ID NOs: 1207 and 1208; SEQ ID NOs: 1209 and 1210; SEQ ID NOs: 1211 and 1212; SEQ ID NOs: 1213 and 1214; SEQ ID NOs: 1215 and 1216; SEQ ID NOs: 1217 and 1218; SEQ ID NOs: 1219 and 1220; SEQ ID NOs: 1221 and 1222; SEQ ID NOs: 1223 and 1224; SEQ ID NOs: 1225 and 1226; SEQ ID NOs: 1227 and 1228; SEQ ID NOs: 1229 and 1230; SEQ ID NOs: 1231 and 1232; SEQ ID NOs: 1233 and 1234; SEQ ID NOs: 1235 and 1236; SEQ ID NOs: 1237 and 1238; SEQ ID NOs: 1239 and 1240; SEQ ID NOs: 1241 and 1242; SEQ ID NOs: 1243 and 1244; SEQ ID NOs: 1245 and 1246; SEQ ID NOs: 1247 and 1248; SEQ ID NOs: 1249 and 1250; SEQ ID NOs: 1251 and 1252; SEQ ID NOs: 1253 and 1254; SEQ ID NOs: 1255 and 1256; SEQ ID NOs: 1257 and 1258; SEQ ID NOs: 1259 and 1260; SEQ ID NOs: 1261 and 1262; SEQ ID NOs: 1263 and 1264; SEQ ID NOs: 1265 and 1266; SEQ ID NOs: 1267 and 1268; SEQ ID NOs: 1269 and 1270; SEQ ID NOs: 1271 and 1272; SEQ ID NOs: 1273 and 1274; SEQ ID NOs: 1275 and 1276; SEQ ID NOs: 1277 and 1278; SEQ ID NOs: 1279 and 1280; SEQ ID NOs: 1281 and 1282; SEQ ID NOs: 1283 and 1284; SEQ ID NOs: 1285 and 1286; SEQ ID NOs: 1287 and 1288; SEQ ID NOs: 1289 and 1290; SEQ ID NOs: 1291 and 1292; SEQ ID NOs: 1293 and 1294; SEQ ID NOs: 1295 and 1296; SEQ ID NOs: 1297 and 1298; SEQ ID NOs: 1299 and 1300; SEQ ID NOs: 1301 and 1302; SEQ ID NOs: 1303 and 1304; SEQ ID NOs: 1305 and 1306; SEQ ID NOs: 1307 and 1308; SEQ ID NOs: 1309 and 1310; SEQ ID NOs: 1311 and 1312; SEQ ID NOs: 1313 and 1314; SEQ ID NOs: 1315 and 1316; SEQ ID NOs: 1317 and 1318; SEQ ID NOs: 1319 and 1320; SEQ ID NOs: 1321 and 1322; SEQ ID NOs: 1323 and 1324; SEQ ID NOs: 1325 and 1326; SEQ ID NOs: 1327 and 1328; SEQ ID NOs: 1329 and 1330; SEQ ID NOs: 1331 and 1332; SEQ ID NOs: 1333 and 1334; SEQ ID NOs: 1335 and 1336; SEQ ID NOs: 1337 and 1338; SEQ ID NOs: 1339 and 1340; SEQ ID NOs: 1341 and 1342; SEQ ID NOs: 1343 and 1344; SEQ ID NOs: 1345 and 1346; SEQ ID NOs: 1347 and 1348; SEQ ID NOs: 1349 and 1350; SEQ ID NOs: 1351 and 1352; SEQ ID NOs: 1353 and 1354; SEQ ID NOs: 1355 and 1356; SEQ ID NOs: 1357 and 1358; SEQ ID NOs: 1359 and 1360; SEQ ID NOs: 1361 and 1362; SEQ ID NOs: 1363 and 1364; SEQ ID NOs: 1365 and 1366; SEQ ID NOs: 1367 and 1368; SEQ ID NOs: 1369 and 1370; SEQ ID NOs: 1371 and 1372; SEQ ID NOs: 1373 and 1374; SEQ ID NOs: 1375 and 1376; SEQ ID NOs: 1377 and 1378; SEQ ID NOs: 1379 and 1380; SEQ ID NOs: 1381 and 1382; SEQ ID NOs: 1383 and 1384; SEQ ID NOs: 1385 and 1386; SEQ ID NOs: 1387 and 1388; SEQ ID NOs: 1389 and 1390; SEQ ID NOs: 1391 and 1392; SEQ ID NOs: 1393 and 1394; SEQ ID NOs: 1395 and 1396; SEQ ID NOs: 1397 and 1398; SEQ ID NOs: 1399 and 1400; and SEQ ID NOs: 1401 and 1402. Similarly, pairwise combinations of sense and antisense strands of Tables 2A, 2B, 3, 5A, 5B, 6, 9, 10-15, 16A, 16B, and 26 of the instant disclosure are also expressly contemplated, including, e.g., a sense strand selected from Table 2A together with an antisense strand selected from Table 2B, or vice versa, etc.

In one embodiment, the substantially complementary sequences of the dsRNA are contained on separate oligonucleotides. In another embodiment, the substantially complementary sequences of the dsRNA are contained on a single oligonucleotide.

It will be understood that, although the sequences in Tables 2A, 2B, 5A, 5B, 9, 10, 12, 14, 16A, 16B, and 26 are described as modified and/or conjugated sequences, the RNA of the RNAi agent of the disclosure e.g., a dsRNA of the disclosure, may comprise any one of the sequences set forth in any one of Tables 2A, 2B, 3, 5A, 5B, 6, 9, 10-15, 16A, 16B, and 26 that is un-modified, un-conjugated, and/or modified and/or conjugated differently than described therein.

The skilled person is well aware that dsRNAs having a duplex structure of between about 20 and 23 base pairs, e.g., 21, base pairs have been hailed as particularly effective in inducing RNA interference (Elbashir et al., (2001) EMBO 1, 20:6877-6888). However, others have found that shorter or longer RNA duplex structures can also be effective (Chu and Rana (2007) RNA 14:1714-1719; Kim et al. (2005) Nat Biotech 23:222-226). In the embodiments described above, by virtue of the nature of the oligonucleotide sequences provided herein, dsRNAs described herein can include at least one strand of a length of minimally 21 nucleotides. It can be reasonably expected that shorter duplexes minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences provided herein, and differing in their ability to inhibit the expression of an APP gene by not more than about 5, 10, 15, 20, 25, or 30% inhibition from a dsRNA comprising the full sequence, are contemplated to be within the scope of the present disclosure.

In addition, the RNAs described herein identify a site(s) in an APP transcript that is susceptible to RISC-mediated cleavage. As such, the present disclosure further features RNAi agents that target within this site(s). As used herein, a RNAi agent is said to target within a particular site of an RNA transcript if the RNAi agent promotes cleavage of the transcript anywhere within that particular site. Such a RNAi agent will generally include at least about 15 contiguous nucleotides from one of the sequences provided herein coupled to additional nucleotide sequences taken from the region contiguous to the selected sequence in an APP gene.

A RNAi agent as described herein can contain one or more mismatches to the target sequence. In one embodiment, a RNAi agent as described herein contains no more than 3 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of an APP gene, generally does not contain any mismatch within the central 13 nucleotides. The methods described herein or methods known in the art can be used to determine whether a RNAi agent containing a mismatch to a target sequence is effective in inhibiting the expression of an APP gene. Consideration of the efficacy of RNAi agents with mismatches in inhibiting expression of an APP gene is important, especially if the particular region of complementarity in an APP gene is known to have polymorphic sequence variation within the population.

III. Modified RNAi Agents of the Disclosure

In one embodiment, the RNA of the RNAi agent of the disclosure e.g., a dsRNA, is un-modified, and does not comprise, e.g., chemical modifications and/or conjugations known in the art and described herein. In another embodiment, the RNA of a RNAi agent of the disclosure, e.g., a dsRNA, is chemically modified to enhance stability or other beneficial characteristics. In certain embodiments of the disclosure, substantially all of the nucleotides of a RNAi agent of the disclosure are modified. In other embodiments of the disclosure, all of the nucleotides of a RNAi agent of the disclosure are modified. RNAi agents of the disclosure in which "substantially all of the nucleotides are modified" are largely but not wholly modified and can include not more than 5, 4, 3, 2, or 1 unmodified nucleotides. In still other embodiments of the disclosure, RNAi agents of the disclosure can include not more than 5, 4, 3, 2 or 1 modified nucleotides.

The nucleic acids featured in the disclosure can be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. Specific examples of RNAi agents useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified RNAi agent will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476, 301; 5,023,243; 5,177,195; 5,188,897; 5,264,423; 5,276, 019; 5,278,302; 5,286,717; 5,321,131; 5,399,676; 5,405, 939; 5,453,496; 5,455,233; 5,466,677; 5,476,925; 5,519, 126; 5,536,821; 5,541,316; 5,550,111; 5,563,253; 5,571, 799; 5,587,361; 5,625,050; 6,028,188; 6,124,445; 6,160, 109; 6,169,170; 6,172,209; 6,239,265; 6,277,603; 6,326, 199; 6,346,614; 6,444,423; 6,531,590; 6,534,639; 6,608, 035; 6,683,167; 6,858,715; 6,867,294; 6,878,805; 7,015, 315; 7,041,816; 7,273,933; 7,321,029; and U.S. Pat.

RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in RNAi agents, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the RNAi agents of the disclosure are described in, for example, in Nielsen et al., *Science*, 1991, 254, 1497-1500.

Some embodiments featured in the disclosure include RNAs with phosphorothioate backbones and oligonucleosides with heteroatom backbones, and in particular—$CH_2$—NH—$CH_2$—, —$CH_2$—N($CH_3$)—O—$CH_2$—[known as a methylene (methylimino) or MMI backbone], —$CH_2$—N($CH_3$)—N($CH_3$)—$CH_2$— and —N($CH_3$)—$CH_2$—$CH_2$— [wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The RNAi agents, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]2$, where n and m are from 1 to about 10.

In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of a RNAi agent, or a group for improving the pharmacodynamic properties of a RNAi agent, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta,* 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2$)$_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$), 2'-O-hexadecyl, and 2'-fluoro (2'-F). Similar modifications can also be made at other positions on the RNA of a RNAi agent, particularly the 3' position of the sugar on the 3' terminal nucleotide or in 2'-5' linked dsRNAs and the 5' position of 5' terminal nucleotide. RNAi agents can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

A RNAi agent of the disclosure can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., (1991) *Angewandte Chemie, International Edition*, 30:613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the disclosure. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

A RNAi agent of the disclosure can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

A RNAi agent of the disclosure can also be modified to include one or more bicyclic sugar moities. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the disclosure may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH$_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the disclosure include without limitation nucleosides comprising a bridge between the 4' and the 2' ribosyl ring atoms. In certain embodiments, the antisense polynucleotide agents of the disclosure include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C(CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J. Org. Chem.*, 2009, 74, 118-134); and 4'-CH2-C(=CH2)-2' (and analogs thereof; see, e.g., U.S. Pat. No. 8,278,426). The entire contents of each of the foregoing are hereby incorporated herein by reference.

Additional representative U.S. patents and US patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

A RNAi agent of the disclosure can also be modified to include one or more constrained ethyl nucleotides. As used herein, a "constrained ethyl nucleotide" or "cEt" is a locked nucleic acid comprising a bicyclic sugar moiety comprising a 4'-CH(CH3)-O-2' bridge. In one embodiment, a constrained ethyl nucleotide is in the S conformation referred to herein as "S-cEt."

A RNAi agent of the disclosure may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US Patent Publication No. 2013/0190383; and PCT publication WO 2013/036868, the entire contents of each of which are hereby incorporated herein by reference.

In some embodiments, a RNAi agent of the disclosure comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of a RNAi agent of the disclosure include a 5' phosphate or 5' phosphate mimic, e.g., a 5'-terminal phosphate or phosphate mimic on the antisense strand of a RNAi agent. Suitable phosphate mimics are disclosed in, for example US Patent Publication No. 2012/0157511, the entire contents of which are incorporated herein by reference.

A. Modified RNAi Agents Comprising Motifs of the Disclosure

In certain aspects of the disclosure, the double-stranded RNAi agents of the disclosure include agents with chemical modifications as disclosed, for example, in WO 2013/075035, filed on Nov. 16, 2012, the entire contents of which are incorporated herein by reference. As shown herein and in PCT Publication No. WO 2013/075035, a superior result may be obtained by introducing one or more motifs of three identical modifications on three consecutive nucleotides into a sense strand and/or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense and/or antisense strand. The RNAi agent may be optionally conjugated with a C16 ligand, for instance on the sense strand. The RNAi agent may be optionally modified with a (S)-glycol nucleic acid (GNA) modification, for instance on one or more residues of the antisense strand. The resulting RNAi agents present superior gene silencing activity.

More specifically, it has been surprisingly discovered that when the sense strand and antisense strand of the double-stranded RNAi agent are completely modified to have one or more motifs of three identical modifications on three consecutive nucleotides at or near the cleavage site of at least one strand of an RNAi agent, the gene silencing activity of the RNAi agent was superiorly enhanced.

Accordingly, the disclosure provides double stranded RNAi agents capable of inhibiting the expression of a target gene (i.e., an APP gene) in vivo. The RNAi agent comprises a sense strand and an antisense strand. Each strand of the RNAi agent may range from 12-30 nucleotides in length. For example, each strand may be between 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as an "RNAi agent." The duplex region of an RNAi agent may be 12-30 nucleotide pairs in length. For example, the duplex region can be between 14-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length.

In one embodiment, the RNAi agent may contain one or more overhang regions and/or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-Omethyl, thymidine (T), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3'-terminal end of the sense strand or, alternatively, at the 3'-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In one embodiment, the RNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5' end.

In another embodiment, the RNAi agent is a double ended bluntmer of 20 nucleotides in length, wherein the sense strand contains at least one motif of three 2'-F modifications on three consecutive nucleotides at positions 8, 9, 10 from the 5' end. The antisense strand contains at least one motif of three 2'-O-methyl modifications on three consecutive nucleotides at positions 11, 12, 13 from the 5' end.

In yet another embodiment, the RNAi agent is a double ended bluntmer of 21 nucleotides in length, wherein the sense strand contains at least one motif of three 2'-F modifications on three consecutive nucleotides at positions 9, 10, 11 from the 5' end. The antisense strand contains at least one motif of three 2'-O-methyl modifications on three consecutive nucleotides at positions 11, 12, 13 from the 5' end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5' end; the antisense strand contains at least one motif of three 2'-O-methyl modifications on three consecutive nucleotides at positions 11, 12, 13 from the 5' end, wherein one end of the RNAi agent is blunt, while the other end comprises a 2 nucleotide overhang. Preferably, the 2 nucleotide overhang is at the 3'-end of the antisense strand. When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (optionally a C16 ligand).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3 ' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The anti sense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region region which is at least 25 nucleotides in length, and the second strand is sufficiently complemenatary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand.

For an RNAi agent having a duplex region of 17-23 nucleotide in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the $1^{st}$ nucleotide from the 5'-end of the antisense strand, or, the count starting from the $1^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adajacent to the first motif or is separated by at least one or more nucleotides. When the motifs are immediately adjacent to each other then the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In one embodiment, the RNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxy-thymine (dT). In another embodiment, the nucleotide at the 3'-end of the antisense strand is deoxy-thymine (dT). In one embodiment, there is a short sequence of deoxy-thymine nucleotides, for example, two dT nucleotides on the 3'-end of the sense and/or antisense strand.

In one embodiment, the sense strand sequence may be represented by formula (I):

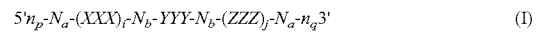

wherein:

i and j are each independently 0 or 1;

p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein Nb and Y do not have the same modification; and

XXX, YYY and ZZZ each independently represent one motif of three identical modifications on three consecutive nucleotides. Preferably YYY is all 2'-F modified nucleotides.

In one embodiment, the $N_a$ and/or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8, 7, 8, 9, 8, 9, 10, 9, 10, 11, 10, 11, 12 or 11, 12, 13) of—the sense strand, the count starting from the 1$^{st}$ nucleotide, from the 5'-end; or optionally, the count starting at the 1$^{st}$ paired nucleotide within the duplex region, from the 5'-end.

In one embodiment, i is 1 and j is 0, or i is 0 and j is 1, or both i and j are 1. The sense strand can therefore be represented by the following formulas:

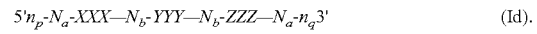

When the sense strand is represented by formula (Ib), $N_b$ represents an oligonucleotide sequence comprising 0-10, 0-7, 0-5, 0-4, 0-2 or 0 modified nucleotides.

Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6. Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

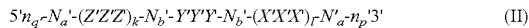  (II)

wherein:

k and l are each independently 0 or 1;

p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification; and

X'X'X', Y'Y'Y' and Z'Z'Z' each independently represent one motif of three identical modifications on three consecutive nucleotides.

In one embodiment, the $N_a'$ and/or $N_b'$ comprise modifications of alternating pattern.

The Y'Y'Y' motif occurs at or near the cleavage site of the antisense strand. For example, when the RNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the 1st nucleotide, from the 5'-end; or optionally, the count starting at the 1st paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

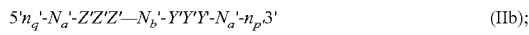  (IIb);

  (IIc); or

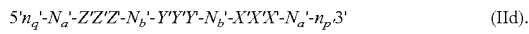  (IId).

When the antisense strand is represented by formula (IIb), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and l is 0 and the antisense strand may be represented by the formula:

  (Ia).

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the 1st nucleotide from the 5'-end, or optionally, the count starting at the 1st paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the 1st nucleotide from the 5'-end, or optionally, the count starting at the 1st paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the RNAi agents for use in the methods of the disclosure may comprise a sense strand and an antisense strand, each strand having 14 to 30 nucleotides, the RNAi duplex represented by formula (III):

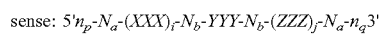

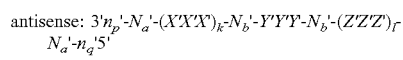  (III)

wherein:

j, k, and l are each independently 0 or 1;

p, p', q, and q' are each independently 0-6;

each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides;

wherein each $n_p'$, $n_p$, $n_q'$, and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

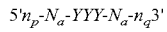

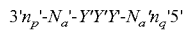 (IIIa)

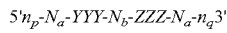

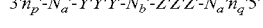 (IIIb)

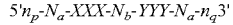

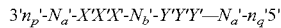 (IIIc)

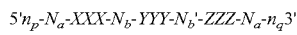

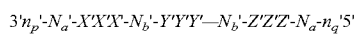 (IIId)

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b'$ independently represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each $N_b$, $N_b'$ independently represents an oligonucleotide sequence comprising 0-10, 0-7, 0-10, 0-7, 0-5, 0-4, 0-2 or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$ and $N_b'$ independently comprises modifications of alternating pattern.

In one embodiment, when the RNAi agent is represented by formula (IIId), the $N_a$ modifications are 2'-O-methyl or 2'-fluoro modifications. In another embodiment, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more C16 (or related) moieties attached through a bivalent or trivalent branched linker (described below). In another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more C16 (or related) moieties, optionally attached through a bivalent or trivalent branched linker.

In one embodiment, when the RNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more C16 (or related) moieties attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to to a ligand. Each of the agents can target the same gene or two different genes; or each of the agents can target same gene at two different target sites.

Various publications describe multimeric RNAi agents that can be used in the methods of the disclosure. Such publications include WO2007/091269, U.S. Pat. No. 7,858, 769, WO2010/141511, WO2007/117686, WO2009/014887 and WO2011/031520 the entire contents of each of which are hereby incorporated herein by reference. In certain embodiments, the RNAi agents of the disclosure may include GalNAc ligands, even if such GalNAc ligands are currently projected to be of limited value for the preferred intrathecal/CNS delivery route(s) of the instant disclosure.

As described in more detail below, the RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and and decalin; preferably, the acyclic group is selected from serinol backbone or diethanolamine backbone.

In certain specific embodiments, the RNAi agent for use in the methods of the disclosure is an agent selected from the group of agents listed in any one of Tables 2A, 2B, 3, 5A, 5B, 6, 9, 10-15, 16A, 16B, and 26. These agents may further comprise a ligand.

IV. APP Knockdown to Treat APP-Associated Diseases

Certain aspects of the instant disclosure are directed to RNAi agent-mediated knockdown of APP-associated diseases or disorders, which include CAA and AD, including hereditary CAA and EOFAD, as well as sporadic and/or late onset AD.

Hereditary CAA (hCAA) is a vascular proteinopathy, for which the amyloid therapeutic hypothesis is relatively straightforward and clinically testable. It is a devastating and rare disease, with no existing therapy. Both biochemical and imaging biomarkers exist for clinical validation of anti-APP siRNA-mediated treatment of hCAA.

One particular type of hCAA contemplated for treatment using the RNAi agents of the instant disclosure is "Dutch type" AP hCAA, which has an estimated patient population in the hundreds, primarily located in the Netherlands and Western Australia. Among APP-associated diseases, hCAA is unique in being purely vascular: in CAA, amyloid fibrils deposit in arterioles and capillaries of CNS parenchyma and leptomeninges, leading to cognitive decline due to cerebral ischemia and microhemorrhages in subjects suffering from CAA. CAA is present in greater than 80% of all AD subjects (with 25% of AD subjects having moderate-severe CAA), and the incidence of CAA rises with the age of a subject, at approximately 50% incidence in elderly over 70 years of age.

The following are exemplary manifestations of hereditary CAA:
Amyloid-beta—Sporadic CAA, HCHWA-Dutch and Italian type EOFAD, LOAD, Trisomy 21
ABri—Familial British Dementia
ADan—Familial Danish Dementia
Cystatin C—HCHWA-Icelandic type (HCHWA-Hereditary cerebral hemorrhage with amyloidosis)
Gelsolin—Familial Amyloidosis-Finnish type
Prion protein—Prion disease
Transthyretin—Hereditary systemic amyloidosis
As noted above, Aβ-hCAA (aka APP-hCAA) is a rapidly progressive, dementing disease associated with intracerebral hemorrhage. Known indications of CAA include both APP-hCAA and sporadic CAA. Possible additional CAA indications include: CAA associated with EOFAD (PSEN1; APP; PSEN2); CAA associated with Down syndrome; and CAA associated with late-onset Alzheimer's disease (for which prevalence is common, as noted above).

For APP-hCAA as an indication, the prevalence of APP-hCAA is not known; however, pure APP-hCAA is less common than EOFAD (Dutch type hCAA (involving an APP E693Q mutation) has been reported in several hundred individuals). Typically, onset of APP-hCAA symptoms occur from age 35-45; and APP-hCAA typically progresses to serious CVA within 2-5 years, resulting in a peak age at death from CVA at age 55.

Sporadic CAA as an indication exhibits relatively high prevalence: it is the common cause of lobar intracerebral hemorrhage (ICH) in the elderly. It is also a rapidly progressive disease, with 86 (36%) of 316 patients developed recurrent ICH over a mean follow up time of 5 years (Van Etten et al. 2016 *Neurology*). Cumulative dementia incidence in sporadic CAA was observed in one study to be 14% at 1 year and 73% at 5 years (Xiong et al. 2017 *J Cerebr Blood Flow Metab*). Sporadic CAA also overlaps extensively with AD, as advanced CAA has been identified as present in approximately 25% of AD brains; however, less than 50% of CAA cases actually meet the pathological criteria for AD.

To assess the efficacy of APP knockdown in a subject treated with a RNAi agent of the instant disclosure, it is expressly contemplated that soluble forms of APP, particularly including APPα and APPβ can serve as cerebrospinal fluid (CSF) biomarkers for assessing APP knockdown efficiency.

Amyloid-β production, elimination and deposition in CAA: converging evidence indicates that the major source of Aβ is neuronal. It is generated by sequential cleavage of amyloid precursor protein (APP) by β- and γ-secretases, in proportion to neuronal activity. Aβ is eliminated from the brain by four major pathways: (a) proteolytic degradation by endopeptidases (such as neprilysin and insulin degrading enzyme (IDE)); (b) receptor mediated clearance by cells in the brain parenchyma (microglia, astrocytes and to a lesser extent neurones); (c) active transport into the blood through the blood-brain barrier (BBB); (d) elimination along the perivascular pathways by which interstitial fluid drains from the brain. Specialized carriers (e.g., ApoE) and/or receptor transport mechanisms (eg, the low density lipoprotein receptor (LDLR) and LDLR related protein (LRP1)) are involved in all major cellular clearance pathways. Vascular deposition is facilitated by factors that increase the Aβ40:Aβ42 ratio (while increased Aβ42 leads to oligomerization and amyloid plaques) and impede perivascular passage. As the clearance mechanisms fail with age, AP is increasingly entrapped from the perivascular drainage pathways into the basement membranes of capillaries and arterioles of the brain leading to CAA. ApoE alleles have a differential effect on different molecular and cellular processes of Aβ production, elimination and deposition in a way that they either increase or decrease the risk of developing CAA (Charidimou A et al. *J Neurol Neurosurg Psychiatry* 2012; 83: 124-137).

Sequential cleavage of APP occurs by two pathways. The APP family of proteins is noted as having large, biologically active, N-terminal ectodomains as well as a shorter C-terminus that contains a crucial Tyrosine-Glutamic Acid-Asparagine-Proline-Threonine-Tyrosine (YENPTY; SEQ ID NO: 1863) protein-sorting domain to which the adaptor proteins X11 and Fe65 bind. The resulting Aβ peptide cleavage product starts within the ectodomain and continues into the transmembrane region. In one pathway, APP is cleaved by α-secretase followed by γ-secretase in performing nonamyloidogenic processing of APP. In a second pathway, amyloidogenic processing of APP involves BACE1 cleavage followed by γ-secretase. Both processes generate soluble ectodomains (sAPPα and sAPPβ) and identical intracellular C-terminal fragments (AICD; SEQ ID NO: 1864; Thinakaran and Koo. *J. Biol. Chem.* 283: 29615-19; Reinhard et al. *The EMBO Journal,* 24: 3996-4006; Walsh et al. *Biochemical Society Transactions,* 35: 416-420; O'Brien and Wong. Annu Rev Neurosci. 34: 185-204).

CAA histopathology includes morphological changes of vessel walls (as revealed by haematoxylin-eosin staining) and Aβ deposition. In leptomeningeal arterioles, significant structural alterations and double barreling have been observed (Charidimou et al. *J Neurol Neurosurg Psychiatry* 83: 124-137). In mild and moderate CAA, only minimal structural changes have been detected; however, in advanced CAA, significant structural alterations have been detected, the most extreme of which is double barrelling (detachment and delamination of the outer part of the tunica media). A similar pathological range of CAA related changes in leptomeningeal arterioles have also been observed using immunohistochemical detection of Aβ. In mild CAA, patchy deposition of amyloid has been observed in the wall of examined vessels. Moderate CAA has shown more dense amyloid deposition which spans the entire vessel wall, while severe CAA has shown double balled vessels and endothelial involvement. Pathological findings of CAA in cortical arterioles has revealed progressive Aβ deposition in proportion to disease severity. Moderate CAA has shown panmural deposition of Aβ along with Aβ deposition in the surrounding brain parenchyma, while in severe CAA, a double barrel vessel has been observed, although this was less common as compared with leptomeningeal vessels (Charidimou et al.).

Pathogenesis of CAA has also been examined. Amyloid beta produced by the brain parenchyma is normally cleared via a perivascular route. Excessive production of Aβ expression of specific CAA-prone Aβ variants and delayed drainage of Aβ has been observed to lead to amyloid deposition in the media of small arteries in the CNS. Soluble and insoluble amyloid fibrils have been identified as toxic to vascular smooth muscle and such fibrils replace these cells, disabling vascular reactivity. Further damage to the endothelium has been observed to lead to microhemorrhages, microinfarcts and tissue destruction leading to dementia. Further progression has caused intracerebral hemorrhage, which has often been observed to be lethal. CAA has been observed to occur most frequently in the occipital lobe, less frequently in the hippocampus, cerebellum, basal ganglia, and not normally in the deep central grey matter, subcortical white matter and brain stem (Charidimou et al.).

Many potential outcome markers have been identified for performance of CAA human studies. In addition to symptomatic intracerebral haemorrhage, microbleeds, white matter hyperintensities (WMH) and amyloid imaging have been associated with disease severity and progression (Greenburg et al., *Lancet Neurol* 13: 419-28).

Available assays can also be used to detect soluble APP levels in human CSF samples. In particular, sAPPα and sAPPβ are soluble forms of APP and have been identified as serving as PD (pharmacodynamic) biomarkers. Analytes have also been detected in non-human primate (NHP) CSF samples, and such assays can enable efficacy studies in NHPs. Detection of Aβ40/42/38 peptides and Total tau/P181 Tau has also been described and is being implemented in the current studies.

Imaging biomarkers are also available for CAA studies, as cerebrovascular function has been identified to reflect pathology in CAA. Imaging has been specifically used to measure blood-oxygen-level-dependent (BOLD) signal after visual stimulation (Van Opstal et al., The lancet Neurology; 16(2); 2017; Peca S et al., Neurology. 2013; 81(19); Switzer A et al., NeuroImage Clinical; 2016). In performing BOLD fMRI in CAA subjects (assessing group blood oxygen level-dependent functional MRI responses for motor and visual tasks), reduced functional MRI activation has been observed for patients with CAA. In particular, BOLD fMRI activity in visual cortex has been observed to be correlated with higher WMH volume and higher microbleed count (Peca et al., *Neurology* 2013; 81(19); Switzer et al. *NeuroImage Clinical* 2016).

Animal models of CAA have also been described, which allow for determination of the effect of APP knockdown on CAA pathology and identification of translatable biomarkers. In particular, multiple rodent models that express mutant human APP and show CAA pathology have been developed, including Tg-SwDI/NOS2−/−. In Tg-SwDI/NOS2−/− model mice, increased AP levels have been identified with increased age of model mice. Perivascular hyperphosphorylated tau protein has also been associated with capillary amyloid not only in Tg-SwDI/NOS2−/− mice but also in human CAA-type 1 samples (Hall and Roberson. Brain Res Bull. 2012; 88(1): 3-12; Attems et al., Nephrology and Applied Neurobiology, 2011, 37, 75-93). A CVN mouse model of AD (APPSDI/NOS2 KO) also exhibited phenotypes including amyloid plaques in the hippocampus, thalamus and cortex, increased tissue inflammation and behavioral deficits. A transgenic rat model (harboring hAPP mutations) has also been developed.

Thus, APP has been identified as a target for hereditary cerebral amyloid angiopathy (CAA). Mutations in APP that have been reported to cause severe forms of CAA include A692G (Flemish), E693Q (Dutch), E693K (Italian), and D694N (Iowa). Meanwhile, mutations in APP that have been described to cause early onset AD include E665D, K670N, M671L (Swedish), T714A (Iranian), T7141 (Austrian), V715M (French), V715A (German), I716V (Florida), I716T, V7171 (London), V717F, V717G and V717L. In particular, the APP E693Q (Dutch) mutation causes severe CAA with few parenchymal neurofibrillary tangles; E693Q increases amyloid beta aggregation and toxicity; E693K (Italian) is similar but E693G (Arctic), E693A and E693delta mutations cause EOFAD with little or no CAA; and APP D694N (Iowa) causes severe CAA with typical AD pathology. In addition to the preceding point mutations, APP duplications that result in APP overexpression have also been identified to cause Aβ deposition. Meanwhile, no known APP mutations have been described that prevent or delay APP-hCAA. In addition to APP mutants, Aβ CAA has also been observed for PSEN1 (L282V) and PSEN2 (N141I) mutations. Meanwhile, ApoE ε2 (independent of AD) and ApoE ε4 (dependent on AD) have also been reported as risk factors for CAA (Rensink A et al., *Brain Research Reviews,* 43 (2) 2003).

Certain aspects of the instant disclosure are directed towards targeting of APP for knockdown in individuals having APP-hCAA. A need exists for such agents because there are currently no disease-modifying therapies for CAA. In certain embodiments, the RNAi agents of the instant disclosure should provide approximately 60-80% knockdown of both mutant and WT APP levels throughout the CNS.

Humans with heterozygous APP mutations exist in the general population with pLI score of 0.3; however, no Human APP knockout has been identified thus far.

Pharmacological attempts to treat human CAA include the following:

Ponezumab, an amyloid beta 40 antibody was studied by Pfizer in 36 individuals with late-onset CAA Three infusions of ponezumab or placebo over the course of 60 days were evaluated for changes in cerebrovascular reactivity as measured by BOLD fMRI, as well as for cerebral edema, infarcts, AP, cognitive change and other secondary outcomes. Ponezumab showed drug-placebo differences, but did not meet the primary endpoint.

BAN2401-. Amyloid beta therapeutic antibodies delivered systemically were identified to be safe but also could cause local cerebral edema. In a recent phase II 18-mo trial of BAN2401 in LOAD, the incidence of SAEs was 17.6% for placebo and 15.5% for the highest dose (10 mg/kg biweekly). Amyloid Related Imaging Abnormalities-Edema (ARIA-E) was 14.6% at the highest dose in APOE4 carriers.

Against animal CAA models, ponezumab was noted as effective in a mouse model of CAA with respect to lowering amyloid beta burden and vascular reactivity (Bales, 2018). Meanwhile, global APP knockout mice have further been noted as viable.

The following exemplary biomarker and pathological data have also provided further validation for the primary role for amyloid beta protein in pathogenesis of CAA:

Hereditary forms of "pure" CAA (i.e., lacking parenchymal plaque amyloid) have been observed as characterized by predominant Aβ40 deposition in amyloid, as opposed to Aβ42 in parenchymal AD;

CAA has been observed as not a "tauopathy", with normal levels of T-tau and P-tau in the CSF, in contrast to elevated levels observed in AD;

The inverse correlation of increasing brain amyloid burden, measured by PiB PET, with decreasing CSF Aβ40 levels has been identified as unique to CAA; and In vitro and in vivo experimental data have provided increasing support to a prion hypothesis in CAA, wherein A1340 containing hereditary CAA mutations has a propensity to misfold and induce misfolding in WT protein, so that both are present in amyloid fibrils (akin to transthyretin (TTR)).

As disclosed in the below Examples, the instant disclosure provides a number of mouse/rat cross reactive APP-targeting duplexes (including, e.g., AD-397177, AD397192, AD-397196, AD-397182, AD397190, AD-397265 and AD-397203), based upon screening results obtained for APP liver mRNA, when duplexes were administered at 2 mg/Kg in a single dose, as assessed at day 21 post-dosing. The instant disclosure also provides a number of human/cynomolgus cross-reactive duplexes (including, e.g., AD-392911, AD-392912, AD-392703, AD-392866, AD-392927, AD-392913, AD-392843, AD-392916, AD-392714, AD-392844, AD-392926, AD-392824, AD-392704 and AD-392790), based upon screening results obtained for treatment of primary cynomolgus hepatocytes and human BE(2)C cells.

RNAi agent-mediated knockdown of EOFAD is also expressly contemplated. Like hCAA, EOFAD is a devastating and rare disease and—as for hCAA—a causal role of APP is well-established and phenotyping of the disease can be performed with greater accuracy and over a shorter duration of time than, e.g., sporadic and/or late onset AD (optionally late onset AD with severe CAA as a subclass of late onset AD). EOFAD is a progressive, dementing neurodegenerative disease in young adults, possessing an age of onset before age 60 to 65 years and often before 55 years of age.

The prevalence of EOFAD has been estimated to be 41.2 per 100,000 for the population at risk (i.e., persons aged 40-59 years), with 61% of those affected by EOFAD having a positive family history of EOFAD (among these, 13% had affected individuals in three generations). EOFAD comprises less than 3% of all AD (Bird, Genetics in Medicine, 10: 231-239; Brien and Wang. Annu Rev Neu Sci, 2011, 34: 185-204; NCBI Gene Reviews).

Providing human genetic validation of the APP target (OMIM 104300), certain APP mutations have been identified that cause EOFAD, including E665D, K670N, M671L (Swedish), T714A (Iranian), T7141 (Austrian), V715M (French), V715A (German), I716V (Florida), I716T, V7171 (London), V717F, V717G and V717L, as described above. In addition, dominant amyloid beta precursor protein mutations have also been identified that cause EOFAD and CAA.

Without wishing to be bound by theory, the pathogenesis of AD is believed to begin in the hippocampus, a ridge of grey matter immediately superior to both lateral ventricles. Degeneration of this tissue is believed to cause the memory loss characteristic of early disease. While the mechanism of neurodegeneration at the protein level has been a matter of great debate, duplications of APP associated with EOFAD have indicated that overexpression of APP may be sufficient to cause AD. (Haass and Selkoe. *Nature Reviews Molecular Cell Biology*, 8: 101-112).

In contrast to EOFAD and CAA, the pathogenic mechanisms of sporadic AD are not yet understood and the population of clinically defined sporadic AD is probably mechanistically heterogeneous.

Certain aspects of the instant disclosure are directed towards targeting of APP for knockdown in individuals having EOFAD. A need exists for such agents because only symptom-directed treatments (of limited efficacy) exist for AD more generally and EOFAD in particular. In certain embodiments, the RNAi agents of the instant disclosure should provide approximately 60-80% knockdown of both mutant and WT APP levels throughout the CNS. One further observation from human genetics that speaks to the likely therapeutic efficacy of an APP-targeted therapy capable of knocking down APP levels in CNS cells is that an A673T mutation was identified that protected carriers from AD and dementia in the general population (Jonsson et al. *Nature Letter*, 488. doi:doi:10.1038/nature11283). The A673T substitution is adjacent to a β-secretase cleavage site, and has been described as resulting in a 40% reduction in amyloid beta in cell assays. Thus, a dominant negative APP point mutant appeared to protect families from AD, further reinforcing that RNAi agent-mediated knockdown of APP could exert a similar protective and/or therapeutic effect in at least certain forms of AD, including EOFAD.

Aiding initial stages of APP-targeting RNAi agent development, it has been noted that APP knockout mice are viable (OMIM 104300), which is expected to allow for viable use of mouse as a model system during lead compound development. In contrast to mice, while humans possessing heterozygous APP mutations exist in the general population with EXAC score of 0.3, no human APP knockout has been identified to date. Biomarkers available for development of APP-targeting RNAi agents include APP and MAPT peptides in CSF, which should allow for rapid assessment and useful efficacy even in a genetically homogeneous population (Mo et al. (2017) Alzheimers & Dementia: Diagnosis, Assessment & Disease Monitoring, 6: 201-209).

As noted above, attempts to treat sporadic forms of AD and EOFAD have to date proven unsuccessful—for example, all trials of BACE1 (β-secretase) inhibitors (BACE1i) for treatment of sporadic AD have thus far failed (Egan et al. *The New England Journal of Medicine*, 378: 1691-1703; Hung and Fu. *Journal of Biomedical Science*, 24: 47). In such BACEi testing, there have been no completed studies in genetically-defined populations (only studies initiated). Notably, the most recent BACEli study showed that verubecestat lowered amyloid beta levels by 60% in a population selected based on age and clinical criteria that suggested a probable diagnosis of AD (Egan et al. *The New England Journal of Medicine*, 378: 1691-1703; Hung and Fu. *Journal of Biomedical Science*, 24: 47). Meanwhile, among Aβ-directed immunotherapies, one such immunotherapy demonstrated proof-of-concept in a recent trial in sporadic AD, supporting initiation of an ongoing Phase III trial (Selkoe and Hardy. *EMBO Molecular Medicine*, 8: 595-608). Given its role in APP cleavage, γ-secretase has also been targeted in certain AD-directed trials. However, to date no γ-secretase inhibitor trials have been completed in a genetically-defined population; and several programs have been discontinued for toxicity (Selkoe and Hardy).

A need therefore exists for agents that can treat or prevent APP-associated diseases or disorders in an affected individual.

It is expressly contemplated that all APP-associated diseases or disorders can ultimately be targeted using the RNAi agents of the instant disclosure—specifically, targeting of sporadic CAA and sporadic and/or late onset AD is also contemplated for the RNAi agents of the instant disclosure, even in view of the diagnostic/phenotyping issues presently confronted for these particular APP-associated diseases (it is further contemplated that diagnostics for these diseases will also continue to improve).

V. RNAi Agents Conjugated to Ligands

Another modification of the RNA of a RNAi agent of the disclosure involves chemically linking to the RNA one or more ligands, moieties or conjugates that enhance the activity, cellular distribution or cellular uptake of the RNAi. Such moieties include but are not limited to lipid moieties such as a cholesterol moiety (Letsinger et al., (1989) *Proc. Natl. Acid. Sci. USA*, 86: 6553-6556), cholic acid (Manoharan et al., (1994) *Biorg. Med. Chem. Let.*, 4:1053-1060), a thioether, e.g., beryl-S-tritylthiol (Manoharan et al., (1992) *Ann. N.Y. Acad. Sci.*, 660:306-309; Manoharan et al., (1993) *Biorg. Med. Chem. Let.*, 3:2765-2770), a thiocholesterol (Oberhauser et al., (1992) *Nucl. Acids Res.*, 20:533-538), an aliphatic chain, e.g., dodecandiol or undecyl residues (Saison-Behmoaras et al., (1991) *EMBO J*, 10:1111-1118; Kabanov et al., (1990) *FEBS Lett.*, 259:327-330; Svinarchuk et al., (1993) *Biochimie*, 75:49-54), a phospholipid, e.g., di-hexadecyl-rac-glycerol or triethyl-ammonium 1,2-di-O-hexadecyl-rac-glycero-3-phosphonate (Manoharan et al., (1995) *Tetrahedron Lett.*, 36:3651-3654; Shea et al., (1990) *Nucl. Acids Res.*, 18:3777-3783), a polyamine or a polyethylene glycol chain (Manoharan et al., (1995) *Nucleosides & Nucleotides*, 14:969-973), or adamantane acetic acid (Manoharan et al., (1995) *Tetrahedron Lett.*, 36:3651-3654), a palmityl moiety (Mishra et al., (1995) *Biochim. Biophys. Acta*, 1264:229-237), or an octadecylamine or hexylaminocarbonyloxycholesterol moiety (Crooke et al., (1996) *J. Pharmacol. Exp. Ther.*, 277:923-937).

In one embodiment, a ligand alters the distribution, targeting or lifetime of a RNAi agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid,O3-(oleoyl) lithocholic acid, 03-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a CNS cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose.

The ligand can be a substance, e.g., a drug, which can increase the uptake of the RNAi agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to a RNAi agent as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present disclosure as ligands (e.g. as PK modulating ligands). In addition, aptamers that bind serum components (e.g. serum proteins) are also suitable for use as PK modulating ligands in the embodiments described herein.

Ligand-conjugated oligonucleotides of the disclosure may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present disclosure may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present disclosure, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present disclosure are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipophilic Moieties

In certain embodiments, the lipophilic moiety is an aliphatic, cyclic such as alicyclic, or polycyclic such as polyalicyclic compound, such as a steroid (e.g., sterol) or a linear or branched aliphatic hydrocarbon. The lipophilic moiety may generally comprises a hydrocarbon chain, which may be cyclic or acyclic. The hydrocarbon chain may comprise various substituents and/or one or more heteroatoms, such as an oxygen or nitrogen atom. Such lipophilic aliphatic moieties include, without limitation, saturated or unsaturated $C_4$-$C_{30}$ hydrocarbon (e.g., $C_6$-$C_{18}$ hydrocarbon), saturated or unsaturated fatty acids, waxes (e.g., monohydric alcohol esters of fatty acids and fatty diamides), terpenes (e.g., $C_{10}$ terpenes, $C_{15}$ sesquiterpenes, $C_{20}$ diterpenes, $C_{30}$ triterpenes, and $C_{40}$ tetraterpenes), and other polyalicyclic hydrocarbons. For instance, the lipophilic moiety may contain a $C_4$-$C_{30}$ hydrocarbon chain (e.g., $C_4$-$C_{30}$ alkyl or alkenyl). In some embodiment the lipophilic moiety contains a saturated or unsaturated $C_6$-$C_{18}$ hydrocarbon chain (e.g., a linear $C_6$-$C_{18}$ alkyl or alkenyl). In one embodiment, the lipophilic moiety contains a saturated or unsaturated $C_{16}$ hydrocarbon chain (e.g., a linear $C_{16}$ alkyl or alkenyl).

The lipophilic moiety may be attached to the RNAi agent by any method known in the art, including via a functional grouping already present in the lipophilic moiety or introduced into the RNAi agent, such as a hydroxy group (e.g., —CO—CH$_2$—OH). The functional groups already present in the lipophilic moiety or introduced into the RNAi agent include, but are not limited to, hydroxyl, amine, carboxylic acid, sulfonate, phosphate, thiol, azide, and alkyne.

Conjugation of the RNAi agent and the lipophilic moiety may occur, for example, through formation of an ether or a carboxylic or carbamoyl ester linkage between the hydroxy and an alkyl group R—, an alkanoyl group RCO— or a substituted carbamoyl group RNHCO—. The alkyl group R may be cyclic (e.g., cyclohexyl) or acyclic (e.g., straight-chained or branched; and saturated or unsaturated). Alkyl group R may be a butyl, pentyl, hexyl, heptyl, octyl, nonyl, decyl, undecyl, dodecyl, tridecyl, tetradecyl, pentadecyl, hexadecyl, heptadecyl or octadecyl group, or the like.

In some embodiments, the lipophilic moiety is conjugated to the double-stranded RNAi agent via a linker a linker containing an ether, thioether, urea, carbonate, amine, amide, maleimide-thioether, disulfide, phosphodiester, sulfonamide linkage, a product of a click reaction (e.g., a triazole from the azide-alkyne cycloaddition), or carbamate.

In another embodiment, the lipophilic moiety is a steroid, such as sterol. Steroids are polycyclic compounds containing a perhydro-1,2-cyclopentanophenanthrene ring system. Steroids include, without limitation, bile acids (e.g., cholic acid, deoxycholic acid and dehydrocholic acid), cortisone, digoxigenin, testosterone, cholesterol, and cationic steroids, such as cortisone. A "cholesterol derivative" refers to a compound derived from cholesterol, for example by substitution, addition or removal of substituents.

In another embodiment, the lipophilic moiety is an aromatic moiety. In this context, the term "aromatic" refers broadly to mono- and polyaromatic hydrocarbons. Aromatic groups include, without limitation, $C_6$-$C_{14}$ aryl moieties comprising one to three aromatic rings, which may be optionally substituted; "aralkyl" or "arylalkyl" groups comprising an aryl group covalently linked to an alkyl group, either of which may independently be optionally substituted or unsubstituted; and "heteroaryl" groups. As used herein, the term "heteroaryl" refers to groups having 5 to 14 ring atoms, preferably 5, 6, 9, or 10 ring atoms; having 6, 10, or 14n electrons shared in a cyclic array, and having, in addition to carbon atoms, between one and about three heteroatoms selected from the group consisting of nitrogen (N), oxygen (O), and sulfur (S).

As employed herein, a "substituted" alkyl, cycloalkyl, aryl, heteroaryl, or heterocyclic group is one having between one and about four, preferably between one and about three, more preferably one or two, non-hydrogen substituents. Suitable substituents include, without limitation, halo, hydroxy, nitro, haloalkyl, alkyl, alkaryl, aryl, aralkyl, alkoxy, aryloxy, amino, acylamino, alkylcarbamoyl, arylcarbamoyl, aminoalkyl, alkoxycarbonyl, carboxy, hydroxyalkyl, alkanesulfonyl, arenesulfonyl, alkanesulfonamido, arenesulfonamido, aralkylsulfonamido, alkylcarbonyl, acyloxy, cyano, and ureido groups.

In some embodiments, the lipophilic moiety is an aralkyl group, e.g., a 2-arylpropanoyl moiety. The structural features of the aralkyl group are selected so that the lipophilic moiety will bind to at least one protein in vivo. In certain embodiments, the structural features of the aralkyl group are selected so that the lipophilic moiety binds to serum, vascular, or cellular proteins. In certain embodiments, the structural features of the aralkyl group promote binding to albumin, an immunoglobulin, a lipoprotein, α-2-macroglubulin, or α-1-glycoprotein.

In certain embodiments, the ligand is naproxen or a structural derivative of naproxen. Procedures for the synthesis of naproxen can be found in U.S. Pat. Nos. 3,904,682 and 4,009,197, which are herey incorporated by reference in their entirety. Naproxen has the chemical name (S)-6-Methoxy-α-methyl-2-naphthaleneacetic acid and the structure is

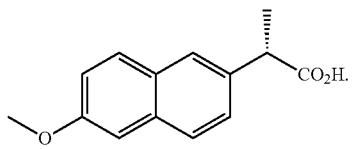 [SMILES: COc1ccc2cc([C@H](C)C(=O)O)ccc2c1]

In certain embodiments, the ligand is ibuprofen or a structural derivative of ibuprofen. Procedures for the synthesis of ibuprofen can be found in U.S. Pat. No. 3,228,831, which are herey incorporated by reference in their entirety. The structure of ibuprofen is

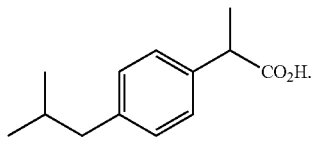

Additional exemplary aralkyl groups are illustrated in U.S. Pat. No. 7,626,014, which is incorporated herein by reference in its entirety.

In another embodiment, suitable lipophilic moieties include lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, ibuprofen, naproxen, dimethoxytrityl, or phenoxazine.

In certain embodiments, more than one lipophilic moieties can be incorporated into the double-strand RNAi agent, particularly when the lipophilic moiety has a low lipophilicity or hydrophobicity. In one embodiment, two or more lipophilic moieties are incorporated into the same strand of the double-strand RNAi agent. In one embodiment, each strand of the double-strand RNAi agent has one or more lipophilic moieties incorporated. In one embodiment, two or more lipophilic moieties are incorporated into the same position (i.e., the same nucleobase, same sugar moiety, or same internucleosidic linkage) of the double-strand RNAi agent. This can be achieved by, e.g., conjugating the two or more lipophilic moieties via a carrier, and/or conjugating the two or more lipophilic moieties via a branched linker, and/or conjugating the two or more lipophilic moieties via one or more linkers, with one or more linkers linking the lipophilic moieties consecutively.

The lipophilic moiety may be conjugated to the RNAi agent via a direct attachment to the ribosugar of the RNAi agent. Alternatively, the lipophilic moiety may be conjugated to the double-strand RNAi agent via a linker or a carrier.

In certain embodiments, the lipophilic moiety may be conjugated to the RNAi agent via one or more linkers (tethers).

In one embodiment, the lipophilic moiety is conjugated to the double-stranded RNAi agent via a linker containing an ether, thioether, urea, carbonate, amine, amide, maleimide-thioether, disulfide, phosphodiester, sulfonamide linkage, a product of a click reaction (e.g., a triazole from the azide-alkyne cycloaddition), or carbamate.

Exemplary linkers, tethers, carriers, nucleic acid modifications, conjugates, ligands and other moieties useful for achieving central nervous system-directed delivery of the APP-targeting RNAi agents of the instant disclosure are described in additional detail, e.g., in U.S. Application Nos. 62/668,072, 62/738,747 and/or 62/773,082, the entire contents of which are incorporated herein by this reference.

B. Lipid Conujugates

In one embodiment, the ligand or conjugate is a lipid or lipid-based molecule. Such a lipid or lipid-based molecule preferably binds a serum protein, e.g., human serum albumin (HSA). An HSA binding ligand allows for vascular distribution of the conjugate to a target tissue, e.g., a non-kidney target tissue of the body. In certain embodiments, the target tissue can be the CNS, including glial cells of the brain. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

Optionally, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as brain cells. Also included are HSA and low density lipoprotein (LDL).

C. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to RNAi agents can affect pharmacokinetic distribution of the RNAi agent, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 29). An RFGF analogue (e.g., amino acid sequence AALLPVLLAAP (SEQ ID NO: 30) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 31) and the *Drosophila* Antennapedia protein (RQIKIWFQNRRMKWKK (SEQ ID NO: 32) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the disclosure may be linear or cyclic, and may be modified, e.g., glyciosylated or methylated, to facilitate targeting to a specific tissue(s). RGD-containing peptides and peptidiomiemtics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

D. Carbohydrate Conjugates and Ligands

In some embodiments of the compositions and methods of the disclosure, an RNAi agent oligonucleotide further comprises a carbohydrate. The carbohydrate conjugated RNAi agents are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In one embodiment, a carbohydrate conjugate for use in the compositions and methods of the disclosure is a monosaccharide.

In certain embodiments, the compositions and methods of the disclosure include a C16 ligand. In exemplary embodiments, the C16 ligand of the disclosure has the following structure (exemplified here below for a uracil base, yet attachment of the C16 ligand is contemplated for a nucleotide presenting any base (C, G, A, etc.) and/or possessing any other modification as presented herein, provided that 2' ribo attachment is preserved) and is attached at the 2' position of the ribo within a residue that is so modified:

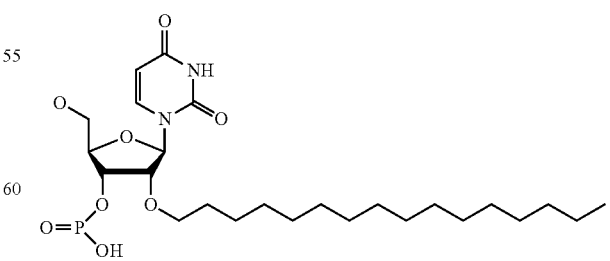

Chemical Formula: $C_{25}H_{43}N_2O_8P$
Exact Mass: 530.2757
Molecular Weight: 530.5913

As shown above, a C16 ligand-modified residue presents a straight chain alkyl at the 2′-ribo position of an exemplary residue (here, a Uracil) that is so modified.

In some embodiments, a carbohydrate conjugate of a RNAi agent of the instant disclosure further comprises one or more additional ligands as described above, such as, but not limited to, a PK modulator and/or a cell permeation peptide.

Additional carbohydrate conjugates (and linkers) suitable for use in the present disclosure include those described in PCT Publication Nos. WO 2014/179620 and WO 2014/179627, the entire contents of each of which are incorporated herein by reference.

In certain embodiments, the compositions and methods of the disclosure include a vinyl phosponate (VP) modification of an RNAi agent as described herein. In exemplary embodiments, a vinyl phosphonate of the disclosure has the following structure:

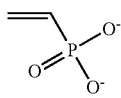

A vinyl phosponate of the instant disclosure may be attached to either the antisense or the sense strand of a dsRNA of the disclosure. In certain preferred embodiments, a vinyl phosphonate of the instant disclosure is attached to the antisense strand of a dsRNA, optionally at the 5′ end of the antisense strand of the dsRNA.

Vinyl phosphate modifications are also contemplated for the compositions and methods of the instant disclosure. An exemplary vinyl phosphate structure is:

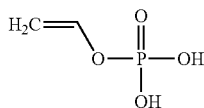

E. Thermally Destabilizing Modifications

In certain embodiments, a dsRNA molecule can be optimized for RNA interference by incorporating thermally destabilizing modifications in the seed region of the antisense strand (i.e., at positions 2-9 of the 5′-end of the antisense strand) to reduce or inhibit off-target gene silencing. It has been discovered that dsRNAs with an antisense strand comprising at least one thermally destabilizing modification of the duplex within the first 9 nucleotide positions, counting from the 5′ end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5′ region of the antisense strand. In some embodiments, one or more thermally destabilizing modification(s) of the duplex is/are located in positions 2-9, or preferably positions 4-8, from the 5′-end of the antisense strand. In some further embodiments, the thermally destabilizing modification(s) of the duplex is/are located at position 6, 7 or 8 from the 5′-end of the antisense strand. In still some further embodiments, the thermally destabilizing modification of the duplex is located at position 7 from the 5′-end of the antisense strand. The term "thermally destabilizing modification(s)" includes modification(s) that would result with a dsRNA with a lower overall melting temperature (Tm) (preferably a Tm with one, two, three or four degrees lower than the Tm of the dsRNA without having such modification(s)). In some embodiments, the thermally destabilizing modification of the duplex is located at position 2, 3, 4, 5 or 9 from the 5′-end of the antisense strand.

The thermally destabilizing modifications can include, but are not limited to, abasic modification; mismatch with the opposing nucleotide in the opposing strand; and sugar modification such as 2′-deoxy modification or acyclic nucleotide, e.g., unlocked nucleic acids (UNA) or glycol nucleic acid (GNA).

Exemplified abasic modifications include, but are not limited to the following:

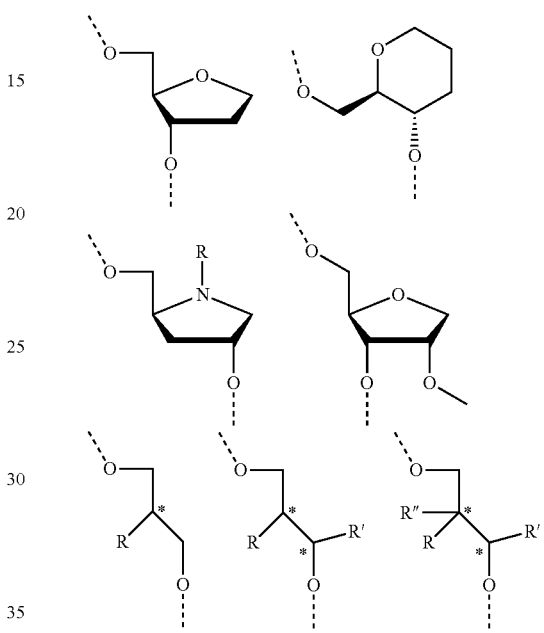

Wherein R=H, Me, Et or OMe; R'=H, Me, Et or OMe; R"=H, Me, Et or OMe

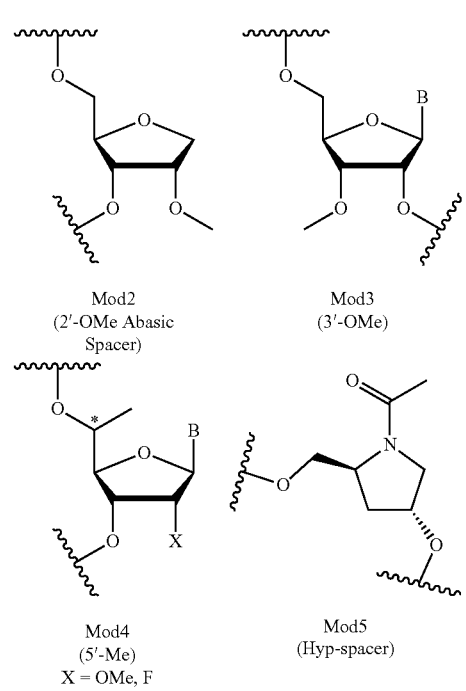

Mod2
(2′-OMe Abasic Spacer)

Mod3
(3′-OMe)

Mod4
(5′-Me)
X = OMe, F

Mod5
(Hyp-spacer)

wherein B is a modified or unmodified nucleobase.

Exemplified sugar modifications include, but are not limited to the following:

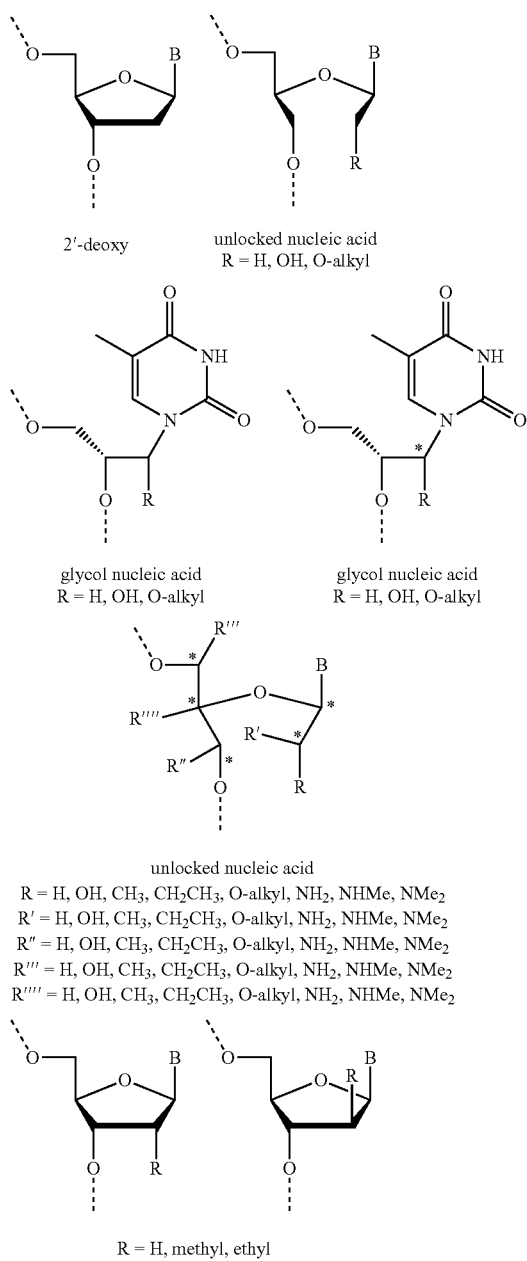

wherein B is a modified or unmodified nucleobase.

In some embodiments the thermally destabilizing modification of the duplex is selected from the group consisting of:

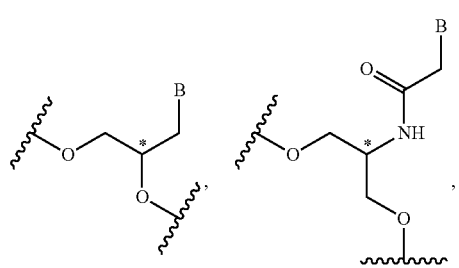

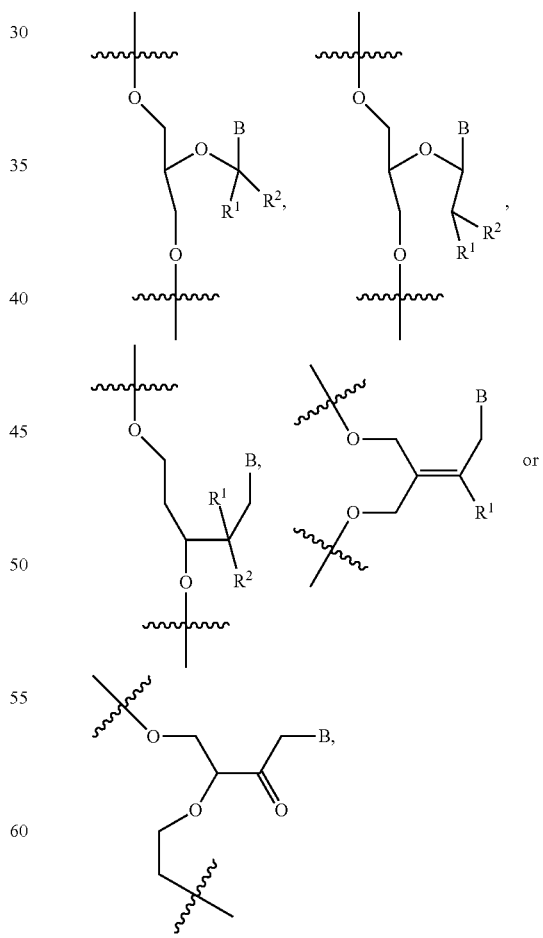

wherein B is a modified or unmodified nucleobase and the asterisk on each structure represents either R, S or racemic.

The term "acyclic nucleotide" refers to any nucleotide having an acyclic ribose sugar, for example, where any of bonds between the ribose carbons (e.g., C1'-C2', C2'-C3', C3'-C4', C4'-O4', or C1'-O4') is absent and/or at least one of ribose carbons or oxygen (e.g., C1', C2', C3', C4' or O4') are independently or in combination absent from the nucleotide. In some embodiments, acyclic nucleotide is wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar). The term "UNA" refers to unlocked acyclic nucleic acid, wherein any of the bonds of the sugar has been removed, forming an unlocked "sugar" residue. In one example, UNA also encompasses monomers with bonds between C1'-C4' being removed (i.e. the covalent carbon-oxygen-carbon bond between the C1' and C4' carbons). In another example, the C2'-C3' bond (i.e. the covalent carbon-carbon bond between the C2' and C3' carbons) of the sugar is removed (see Mikhailov et. al., Tetrahedron Letters, 26 (17): 2059 (1985); and Fluiter et al., Mol. Biosyst., 10: 1039 (2009), which are hereby incorporated by reference in their entirety). The acyclic derivative provides greater backbone flexibility without affecting the Watson-Crick pairings. The acyclic nucleotide can be linked via 2'-5' or 3'-5' linkage.

The term 'GNA' refers to glycol nucleic acid which is a polymer similar to DNA or RNA but differing in the composition of its "backbone" in that is composed of repeating glycerol units linked by phosphodiester bonds:

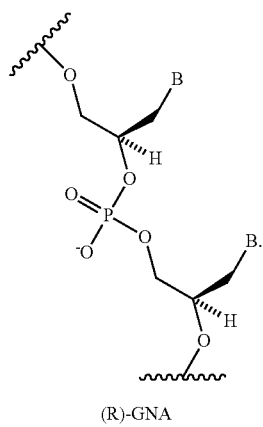

(R)-GNA

The thermally destabilizing modification of the duplex can be mismatches (i.e., noncomplementary base pairs) between the thermally destabilizing nucleotide and the opposing nucleotide in the opposite strand within the dsRNA duplex. Exemplary mismatch base pairs include G:G, G:A, G:U, G:T, A:A, A:C, C:C, C:U, C:T, U:U, T:T, U:T, or a combination thereof. Other mismatch base pairings known in the art are also amenable to the present invention. A mismatch can occur between nucleotides that are either naturally occurring nucleotides or modified nucleotides, i.e., the mismatch base pairing can occur between the nucleobases from respective nucleotides independent of the modifications on the ribose sugars of the nucleotides. In certain embodiments, the dsRNA molecule contains at least one nucleobase in the mismatch pairing that is a 2'-deoxy nucleobase; e.g., the 2'-deoxy nucleobase is in the sense strand.

In some embodiments, the thermally destabilizing modification of the duplex in the seed region of the antisense strand includes nucleotides with impaired W—C H-bonding to complementary base on the target mRNA, such as:

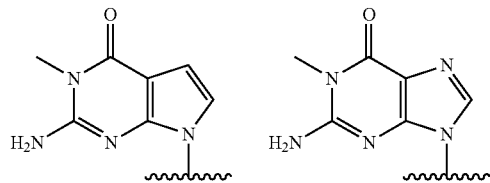

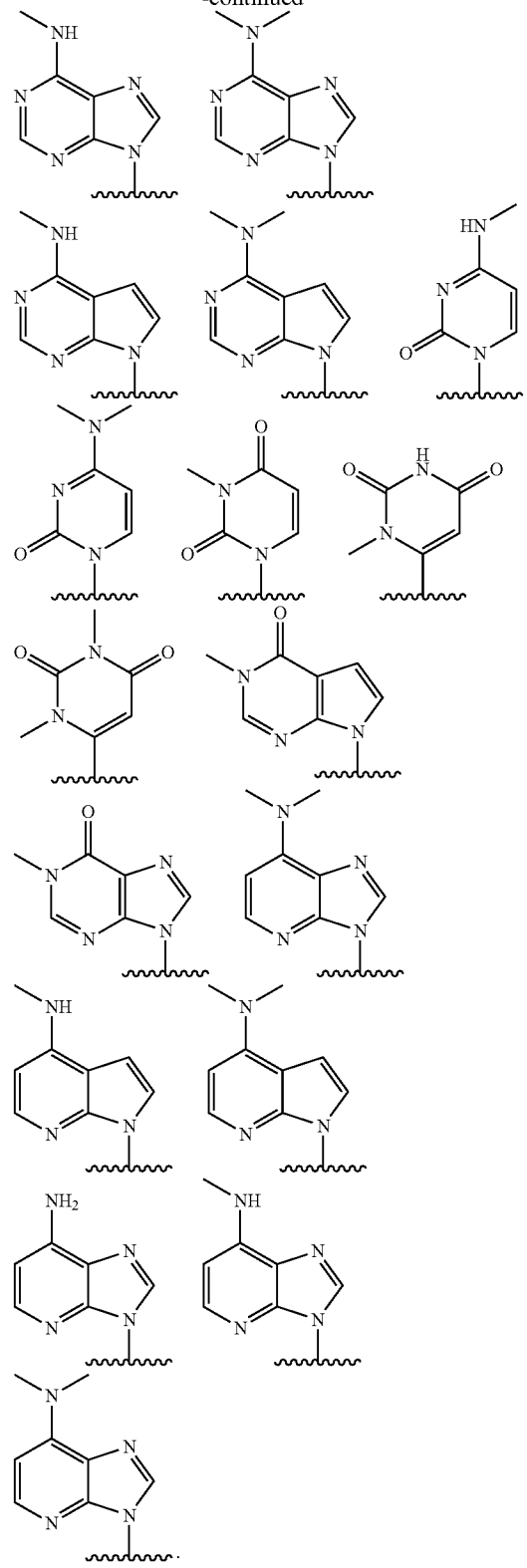

More examples of abasic nucleotide, acyclic nucleotide modifications (including UNA and GNA), and mismatch modifications have been described in detail in WO 2011/133876, which is herein incorporated by reference in its entirety.

The thermally destabilizing modifications may also include universal base with reduced or abolished capability to form hydrogen bonds with the opposing bases, and phosphate modifications.

In some embodiments, the thermally destabilizing modification of the duplex includes nucleotides with non-canonical bases such as, but not limited to, nucleobase modifications with impaired or completely abolished capability to form hydrogen bonds with bases in the opposite strand. These nucleobase modifications have been evaluated for destabilization of the central region of the dsRNA duplex as described in WO 2010/0011895, which is herein incorporated by reference in its entirety. Exemplary nucleobase modifications are:

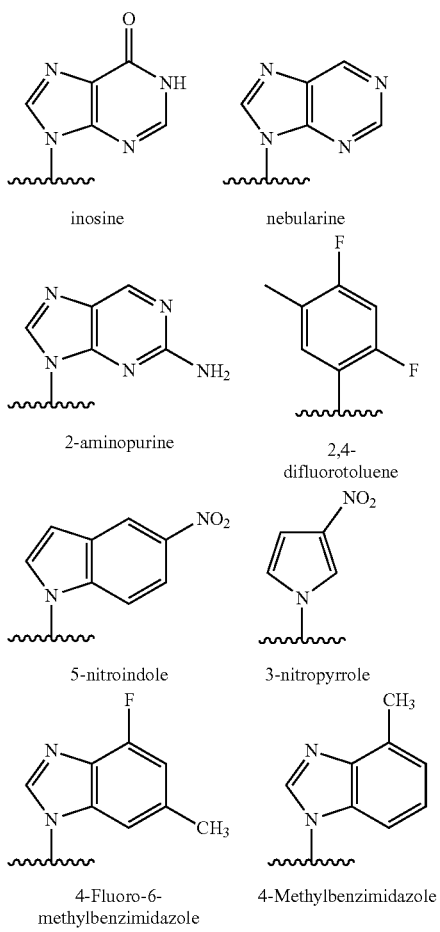

In some embodiments, the thermally destabilizing modification of the duplex in the seed region of the antisense strand includes one or more α-nucleotide complementary to the base on the target mRNA, such as:

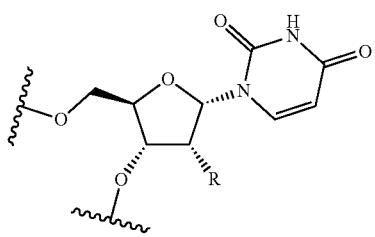

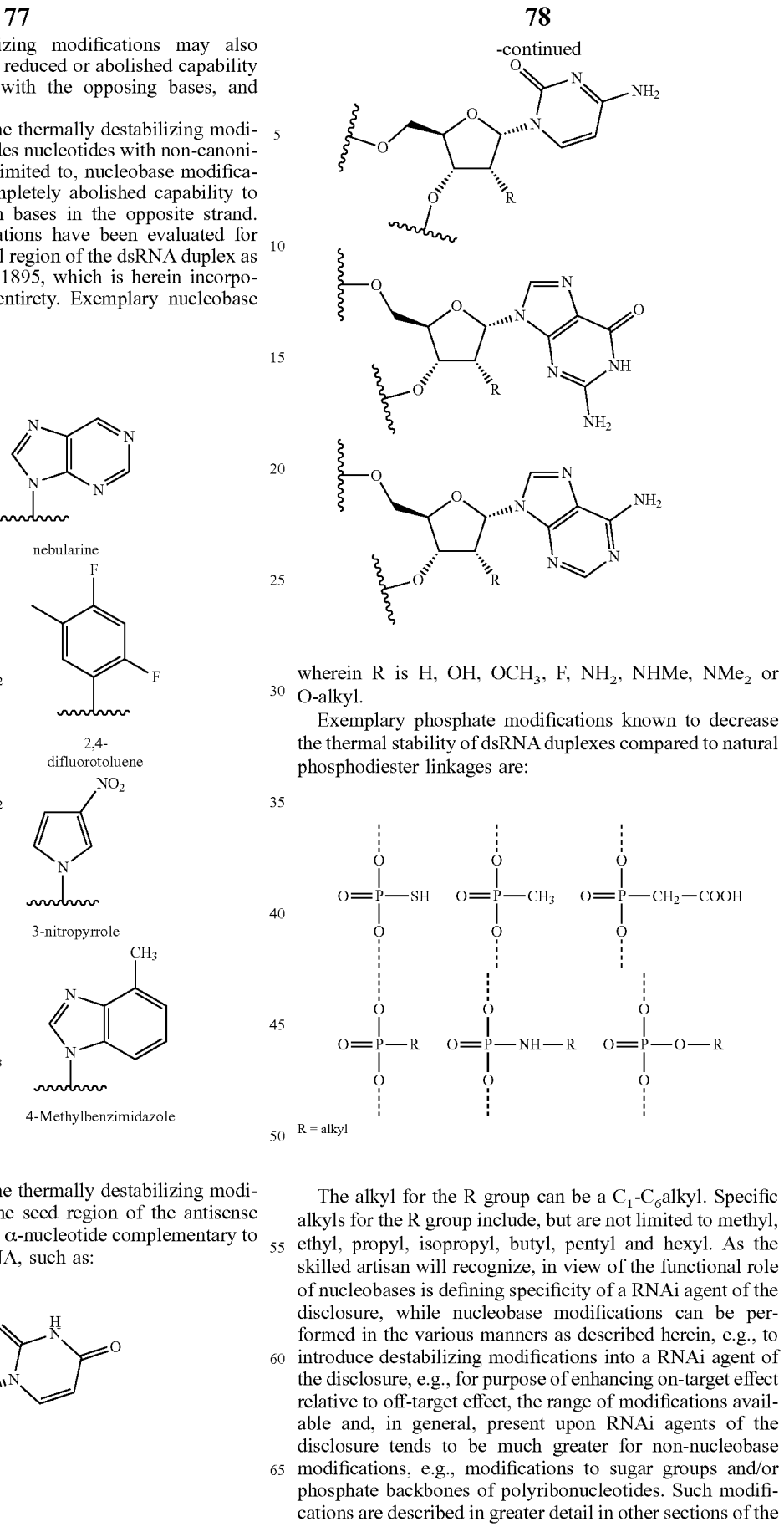

wherein R is H, OH, OCH$_3$, F, NH$_2$, NHMe, NMe$_2$ or O-alkyl.

Exemplary phosphate modifications known to decrease the thermal stability of dsRNA duplexes compared to natural phosphodiester linkages are:

The alkyl for the R group can be a C$_1$-C$_6$alkyl. Specific alkyls for the R group include, but are not limited to methyl, ethyl, propyl, isopropyl, butyl, pentyl and hexyl. As the skilled artisan will recognize, in view of the functional role of nucleobases is defining specificity of a RNAi agent of the disclosure, while nucleobase modifications can be performed in the various manners as described herein, e.g., to introduce destabilizing modifications into a RNAi agent of the disclosure, e.g., for purpose of enhancing on-target effect relative to off-target effect, the range of modifications available and, in general, present upon RNAi agents of the disclosure tends to be much greater for non-nucleobase modifications, e.g., modifications to sugar groups and/or phosphate backbones of polyribonucleotides. Such modifications are described in greater detail in other sections of the instant disclosure and are expressly contemplated for RNAi agents of the disclosure, either possessing native nucleobases or modified nucleobases as described above and/or elsewhere herein.

In addition to the antisense strand comprising a thermally destabilizing modification, the dsRNA can also comprise one or more stabilizing modifications. For example, the dsRNA can comprise at least two (e.g., two, three, four, five, six, seven, eight, nine, ten or more) stabilizing modifications. Without limitations, the stabilizing modifications all can be present in one strand. In some embodiments, both the sense and the antisense strands comprise at least two stabilizing modifications. The stabilizing modification can occur on any nucleotide of the sense strand or antisense strand. For instance, the stabilizing modification can occur on every nucleotide on the sense strand and/or antisense strand; each stabilizing modification can occur in an alternating pattern on the sense strand or antisense strand; or the sense strand or antisense strand comprises both stabilizing modification in an alternating pattern. The alternating pattern of the stabilizing modifications on the sense strand may be the same or different from the antisense strand, and the alternating pattern of the stabilizing modifications on the sense strand can have a shift relative to the alternating pattern of the stabilizing modifications on the antisense strand.

In some embodiments, the antisense strand comprises at least two (e.g., two, three, four, five, six, seven, eight, nine, ten or more) stabilizing modifications. Without limitations, a stabilizing modification in the antisense strand can be present at any positions. In some embodiments, the antisense comprises stabilizing modifications at positions 2, 6, 8, 9, 14 and 16 from the 5'-end. In some other embodiments, the antisense comprises stabilizing modifications at positions 2, 6, 14 and 16 from the 5'-end. In still some other embodiments, the antisense comprises stabilizing modifications at positions 2, 14 and 16 from the 5'-end.

In some embodiments, the antisense strand comprises at least one stabilizing modification adjacent to the destabilizing modification. For example, the stabilizing modification can be the nucleotide at the 5'-end or the 3'-end of the destabilizing modification, i.e., at position −1 or +1 from the position of the destabilizing modification. In some embodiments, the antisense strand comprises a stabilizing modification at each of the 5'-end and the 3'-end of the destabilizing modification, i.e., positions −1 and +1 from the position of the destabilizing modification.

In some embodiments, the antisense strand comprises at least two stabilizing modifications at the 3'-end of the destabilizing modification, i.e., at positions +1 and +2 from the position of the destabilizing modification.

In some embodiments, the sense strand comprises at least two (e.g., two, three, four, five, six, seven, eight, nine, ten or more) stabilizing modifications. Without limitations, a stabilizing modification in the sense strand can be present at any positions. In some embodiments, the sense strand comprises stabilizing modifications at positions 7, 10 and 11 from the 5'-end. In some other embodiments, the sense strand comprises stabilizing modifications at positions 7, 9, 10 and 11 from the 5'-end. In some embodiments, the sense strand comprises stabilizing modifications at positions opposite or complimentary to positions 11, 12 and 15 of the antisense strand, counting from the 5'-end of the antisense strand. In some other embodiments, the sense strand comprises stabilizing modifications at positions opposite or complimentary to positions 11, 12, 13 and 15 of the antisense strand, counting from the 5'-end of the antisense strand. In some embodiments, the sense strand comprises a block of two, three or four stabilizing modifications.

In some embodiments, the sense strand does not comprise a stabilizing modification in position opposite or complimentary to the thermally destabilizing modification of the duplex in the antisense strand.

Exemplary thermally stabilizing modifications include, but are not limited to 2'-fluoro modifications. Other thermally stabilizing modifications include, but are not limited to LNA.

In some embodiments, the dsRNA of the disclosure comprises at least four (e.g., four, five, six, seven, eight, nine, ten or more) 2'-fluoro nucleotides. Without limitations, the 2'-fluoro nucleotides all can be present in one strand. In some embodiments, both the sense and the antisense strands comprise at least two 2'-fluoro nucleotides. The 2'-fluoro modification can occur on any nucleotide of the sense strand or antisense strand. For instance, the 2'-fluoro modification can occur on every nucleotide on the sense strand and/or antisense strand; each 2'-fluoro modification can occur in an alternating pattern on the sense strand or antisense strand; or the sense strand or antisense strand comprises both 2'-fluoro modifications in an alternating pattern. The alternating pattern of the 2'-fluoro modifications on the sense strand may be the same or different from the antisense strand, and the alternating pattern of the 2'-fluoro modifications on the sense strand can have a shift relative to the alternating pattern of the 2'-fluoro modifications on the antisense strand.

In some embodiments, the antisense strand comprises at least two (e.g., two, three, four, five, six, seven, eight, nine, ten or more) 2'-fluoro nucleotides. Without limitations, a 2'-fluoro modification in the antisense strand can be present at any positions. In some embodiments, the antisense comprises 2'-fluoro nucleotides at positions 2, 6, 8, 9, 14 and 16 from the 5'-end. In some other embodiments, the antisense comprises 2'-fluoro nucleotides at positions 2, 6, 14 and 16 from the 5'-end. In still some other embodiments, the antisense comprises 2'-fluoro nucleotides at positions 2, 14 and 16 from the 5'-end.

In some embodiments, the antisense strand comprises at least one 2'-fluoro nucleotide adjacent to the destabilizing modification. For example, the 2'-fluoro nucleotide can be the nucleotide at the 5'-end or the 3'-end of the destabilizing modification, i.e., at position −1 or +1 from the position of the destabilizing modification. In some embodiments, the antisense strand comprises a 2'-fluoro nucleotide at each of the 5'-end and the 3'-end of the destabilizing modification, i.e., positions −1 and +1 from the position of the destabilizing modification.

In some embodiments, the antisense strand comprises at least two 2'-fluoro nucleotides at the 3'-end of the destabilizing modification, i.e., at positions +1 and +2 from the position of the destabilizing modification.

In some embodiments, the sense strand comprises at least two (e.g., two, three, four, five, six, seven, eight, nine, ten or more) 2'-fluoro nucleotides. Without limitations, a 2'-fluoro modification in the sense strand can be present at any positions. In some embodiments, the antisense comprises 2'-fluoro nucleotides at positions 7, 10 and 11 from the 5'-end. In some other embodiments, the sense strand comprises 2'-fluoro nucleotides at positions 7, 9, 10 and 11 from the 5'-end. In some embodiments, the sense strand comprises 2'-fluoro nucleotides at positions opposite or complimentary to positions 11, 12 and 15 of the antisense strand, counting from the 5'-end of the antisense strand. In some other embodiments, the sense strand comprises 2'-fluoro nucleotides at positions opposite or complimentary to positions 11, 12, 13 and 15 of the antisense strand, counting from the 5'-end of the antisense strand. In some embodiments, the sense strand comprises a block of two, three or four 2'-fluoro nucleotides.

In some embodiments, the sense strand does not comprise a 2'-fluoro nucleotide in position opposite or complimentary to the thermally destabilizing modification of the duplex in the antisense strand.

In some embodiments, the dsRNA molecule of the disclosure comprises a 21 nucleotides (nt) sense strand and a 23 nucleotides (nt) antisense, wherein the antisense strand contains at least one thermally destabilizing nucleotide, where the at least one thermally destabilizing nucleotide occurs in the seed region of the antisense strand (i.e., at position 2-9 of the 5'-end of the antisense strand), wherein one end of the dsRNA is blunt, while the other end is comprises a 2 nt overhang, and wherein the dsRNA optionally further has at least one (e.g., one, two, three, four, five, six or all seven) of the following characteristics: (i) the antisense comprises 2, 3, 4, 5 or 6 2'-fluoro modifications; (ii) the antisense comprises 1, 2, 3, 4 or 5 phosphorothioate internucleotide linkages; (iii) the sense strand is conjugated with a ligand; (iv) the sense strand comprises 2, 3, 4 or 5 2'-fluoro modifications; (v) the sense strand comprises 1, 2, 3, 4 or 5 phosphorothioate internucleotide linkages; (vi) the dsRNA comprises at least four 2'-fluoro modifications; and (vii) the dsRNA comprises a blunt end at 5'-end of the antisense strand. Preferably, the 2 nt overhang is at the 3'-end of the antisense.

In some embodiments, the dsRNA molecule of the disclosure comprising a sense and antisense strands, wherein: the sense strand is 25-30 nucleotide residues in length, wherein starting from the 5' terminal nucleotide (position 1), positions 1 to 23 of said sense strand comprise at least 8 ribonucleotides; antisense strand is 36-66 nucleotide residues in length and, starting from the 3' terminal nucleotide, at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when said double stranded nucleic acid is introduced into a mammalian cell; and wherein the antisense strand contains at least one thermally destabilizing nucleotide, where at least one thermally destabilizing nucleotide is in the seed region of the antisense strand (i.e. at position 2-9 of the 5'-end of the antisense strand). For example, the thermally destabilizing nucleotide occurs between positions opposite or complimentary to positions 14-17 of the 5'-end of the sense strand, and wherein the dsRNA optionally further has at least one (e.g., one, two, three, four, five, six or all seven) of the following characteristics: (i) the antisense comprises 2, 3, 4, 5 or 6 2'-fluoro modifications; (ii) the antisense comprises 1, 2, 3, 4 or 5 phosphorothioate internucleotide linkages; (iii) the sense strand is conjugated with a ligand; (iv) the sense strand comprises 2, 3, 4 or 5 2'-fluoro modifications; (v) the sense strand comprises 1, 2, 3, 4 or 5 phosphorothioate internucleotide linkages; and (vi) the dsRNA comprises at least four 2'-fluoro modifications; and (vii) the dsRNA comprises a duplex region of 12-30 nucleotide pairs in length.

In some embodiments, the dsRNA molecule of the disclosure comprises a sense and antisense strands, wherein said dsRNA molecule comprises a sense strand having a length which is at least 25 and at most 29 nucleotides and an antisense strand having a length which is at most 30 nucleotides with the sense strand comprises a modified nucleotide that is susceptible to enzymatic degradation at position 11 from the 5'end, wherein the 3' end of said sense strand and the 5' end of said antisense strand form a blunt end and said antisense strand is 1-4 nucleotides longer at its 3' end than the sense strand, wherein the duplex region which is at least 25 nucleotides in length, and said antisense strand is sufficiently complementary to a target mRNA along at least 19 nt of said antisense strand length to reduce target gene expression when said dsRNA molecule is introduced into a mammalian cell, and wherein dicer cleavage of said dsRNA preferentially results in an siRNA comprising said 3' end of said antisense strand, thereby reducing expression of the target gene in the mammal, wherein the antisense strand contains at least one thermally destabilizing nucleotide, where the at least one thermally destabilizing nucleotide is in the seed region of the antisense strand (i.e. at position 2-9 of the 5'-end of the antisense strand), and wherein the dsRNA optionally further has at least one (e.g., one, two, three, four, five, six or all seven) of the following characteristics: (i) the antisense comprises 2, 3, 4, 5 or 6 2'-fluoro modifications; (ii) the antisense comprises 1, 2, 3, 4 or 5 phosphorothioate internucleotide linkages; (iii) the sense strand is conjugated with a ligand; (iv) the sense strand comprises 2, 3, 4 or 5 2'-fluoro modifications; (v) the sense strand comprises 1, 2, 3, 4 or 5 phosphorothioate internucleotide linkages; and (vi) the dsRNA comprises at least four 2'-fluoro modifications; and (vii) the dsRNA has a duplex region of 12-29 nucleotide pairs in length.

In some embodiments, every nucleotide in the sense strand and antisense strand of the dsRNA molecule may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking 0 of a phosphate moiety. In some cases the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a RNA or may only occur in a single strand region of a RNA. E.g., a phosphorothioate modification at a non-linking 0 position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. E.g., it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, HNA, CeNA, 2'-methoxyethyl, 2'-O-methyl, 2'-O-allyl, 2'-C-allyl, 2'-deoxy, or 2'-fluoro. The strands can contain more than one modification. In some embodiments, each residue of the sense strand and antisense strand is independently modified with 2'-O-methyl or 2'-fluoro. It is to be understood that these modifications are in addition to the at least one thermally destabilizing modification of the duplex present in the anti sense strand.

At least two different modifications are typically present on the sense strand and antisense strand. Those two modifications may be the 2'-deoxy, 2'-O-methyl or 2'-fluoro modifications, acyclic nucleotides or others. In some embodiments, the sense strand and antisense strand each comprises two differently modified nucleotides selected from 2'-O-methyl or 2'-deoxy. In some embodiments, each residue of the sense strand and antisense strand is independently modified with 2'-O-methyl nucleotide, 2'-deoxy nucleotide, 2"-deoxy-2'-fluoro nucleotide, 2'-O—N-methylacetamido (2'-O-NMA) nucleotide, a 2'-O-dimethylaminoethoxyethyl (2'-O-DMAEOE) nucleotide, 2'-O-aminopropyl (2'-O-AP) nucleotide, or 2'-ara-F nucleotide. Again, it is to be understood that these modifications are in addition to the at least one thermally destabilizing modification of the duplex present in the antisense strand.

In some embodiments, the dsRNA molecule of the disclosure comprises modifications of an alternating pattern, particular in the B1, B2, B3, B1', B2', B3', B4' regions. The term "alternating motif" or "alternative pattern" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAAB-BAABB . . . ," "AABAABAABAAB . . . ," "AAABAAA-BAAAB . . . ," "AAABBBAAABBB . . . ," or "ABCAB-CABCABC . . . ," etc. The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In some embodiments, the dsRNA molecule of the disclosure comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 3'-5' of the strand within the duplex region. As another example, the alternating motif in the sense strand may start with "AABBAABB" from 5'-3' of the strand and the alternating motif in the antisense strand may start with "BBAABBAA" from 3'-5' of the strand within the duplex region, so that there is a complete or partial shift of the modification patterns between the sense strand and the antisense strand.

The dsRNA molecule of the disclosure may further comprise at least one phosphorothioate or methylphosphonate internucleotide linkage. The phosphorothioate or methylphosphonate internucleotide linkage modification may occur on any nucleotide of the sense strand or antisense strand or both in any position of the strand. For instance, the internucleotide linkage modification may occur on every nucleotide on the sense strand and/or antisense strand; each internucleotide linkage modification may occur in an alternating pattern on the sense strand or antisense strand; or the sense strand or antisense strand comprises both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In some embodiments, the dsRNA molecule comprises the phosphorothioate or methylphosphonate internucleotide linkage modification in the overhang region. For example, the overhang region comprises two nucleotides having a phosphorothioate or methylphosphonate internucleotide linkage between the two nucleotides. Internucleotide linkage modifications also may be made to link the overhang nucleotides with the terminal paired nucleotides within duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. Preferably, these terminal three nucleotides may be at the 3'-end of the antisense strand.

In some embodiments, the sense strand of the dsRNA molecule comprises 1-10 blocks of two to ten phosphorothioate or methylphosphonate internucleotide linkages separated by 1, 2, 3, 4, 5, 6, 7, 8, 9, 10, 11, 12, 13, 14, 15 or 16 phosphate internucleotide linkages, wherein one of the phosphorothioate or methylphosphonate internucleotide linkages is placed at any position in the oligonucleotide sequence and the said sense strand is paired with an antisense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of two phosphorothioate or methylphosphonate internucleotide linkages separated by 1, 2, 3, 4, 5, 6, 7, 8, 9, 10, 11, 12, 13, 14, 15, 16, 17, or 18 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of three phosphorothioate or methylphosphonate internucleotide linkages separated by 1, 2, 3, 4, 5, 6, 7, 8, 9, 10, 11, 12, 13, 14, 15 or 16 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of four phosphorothioate or methylphosphonate internucleotide linkages separated by 1, 2, 3, 4, 5, 6, 7, 8, 9, 10, 11, 12, 13 or 14 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of five phosphorothioate or methylphosphonate internucleotide linkages separated by 1, 2, 3, 4, 5, 6, 7, 8, 9, 10, 11 or 12 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of six phosphorothioate or methylphosphonate internucleotide linkages separated by 1, 2, 3, 4, 5, 6, 7, 8, 9 or 10 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of seven phosphorothioate or methylphosphonate internucleotide linkages separated by 1, 2, 3, 4, 5, 6, 7 or 8 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of eight phosphorothioate or methylphosphonate internucleotide linkages separated by 1, 2, 3, 4, 5 or 6 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of nine phosphorothioate or methylphosphonate internucleotide linkages separated by 1, 2, 3 or 4 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the dsRNA molecule of the disclosure further comprises one or more phosphorothioate or methylphosphonate internucleotide linkage modification within 1-10 of the termini position(s) of the sense and/or antisense strand. For example, at least 2, 3, 4, 5, 6, 7, 8, 9 or 10 nucleotides may be linked through phosphorothioate or methylphosphonate internucleotide linkage at one end or both ends of the sense and/or antisense strand.

In some embodiments, the dsRNA molecule of the disclosure further comprises one or more phosphorothioate or methylphosphonate internucleotide linkage modification within 1-10 of the internal region of the duplex of each of the sense and/or antisense strand. For example, at least 2, 3, 4, 5, 6, 7, 8, 9 or 10 nucleotides may be linked through phosphorothioate methylphosphonate internucleotide linkage at position 8-16 of the duplex region counting from the 5'-end of the sense strand; the dsRNA molecule can optionally further comprise one or more phosphorothioate or methylphosphonate internucleotide linkage modification within 1-10 of the termini position(s).

In some embodiments, the dsRNA molecule of the disclosure further comprises one to five phosphorothioate or methylphosphonate internucleotide linkage modification(s) within position 1-5 and one to five phosphorothioate or methylphosphonate internucleotide linkage modification(s) within position 18-23 of the sense strand (counting from the 5'-end), and one to five phosphorothioate or methylphosphonate internucleotide linkage modification at positions 1 and 2 and one to five within positions 18-23 of the antisense strand (counting from the 5'-end).

In some embodiments, the dsRNA molecule of the disclosure further comprises one phosphorothioate internucleotide linkage modification within position 1-5 and one phosphorothioate or methylphosphonate internucleotide linkage modification within position 18-23 of the sense strand (counting from the 5'-end), and one phosphorothioate internucleotide linkage modification at positions 1 and 2 and two phosphorothioate or methylphosphonate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises one phosphorothioate internucleotide linkage modification within position 1-5 and one within position 18-23 of the sense strand (counting from the 5'-end), and two phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 (counting from the 5'-end) of the sense strand, and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 (counting from the 5'-end) of the sense strand, and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one within position 18-23 of the sense strand (counting from the 5'-end), and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 20 and 21 of the sense strand (counting from the 5'-end), and one phosphorothioate internucleotide linkage modification at positions 1 and one at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 20 and 21 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 21 and 22 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 21 and 22 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 22 and 23 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 23 and 23 the antisense strand (counting from the 5'-end).

In some embodiments, compound of the disclosure comprises a pattern of backbone chiral centers. In some embodiments, a common pattern of backbone chiral centers comprises at least 5 internucleotidic linkages in the Sp configuration. In some embodiments, a common pattern of backbone chiral centers comprises at least 6 internucleotidic linkages in the Sp configuration. In some embodiments, a common pattern of backbone chiral centers comprises at least 7 internucleotidic linkages in the Sp configuration. In some embodiments, a common pattern of backbone chiral centers comprises at least 8 internucleotidic linkages in the Sp configuration. In some embodiments, a common pattern of backbone chiral centers comprises at least 9 internucleotidic linkages in the Sp configuration. In some embodiments, a common pattern of backbone chiral centers comprises at least 10 internucleotidic linkages in the Sp configuration. In some embodiments, a common pattern of backbone chiral centers comprises at least 11 internucleotidic linkages in the Sp configuration. In some embodiments, a common pattern of backbone chiral centers comprises at least 12 internucleotidic linkages in the Sp configuration. In some embodiments, a common pattern of backbone chiral centers comprises at least 13 internucleotidic linkages in the Sp configuration. In some embodiments, a common pattern of backbone chiral centers comprises at least 14 internucleotidic linkages in the Sp configuration. In some embodiments, a common pattern of backbone chiral centers comprises at least 15 internucleotidic linkages in the Sp configuration. In some embodiments, a common pattern of backbone chiral centers comprises at least 16 internucleotidic linkages in the Sp configuration. In some embodiments, a common pattern of backbone chiral centers comprises at least 17 internucleotidic linkages in the Sp configuration. In some embodiments, a common pattern of backbone chiral centers comprises at least 18 internucleotidic linkages in the Sp configuration. In some embodiments, a common pattern of backbone chiral centers comprises at least 19 internucleotidic linkages in the Sp configuration. In some embodiments, a common pattern of backbone chiral centers comprises no more than 8 internucleotidic linkages in the Rp configuration. In some embodiments, a common pattern of backbone chiral centers comprises no more than 7 internucleotidic linkages in the Rp configuration. In some embodiments, a common pattern of backbone chiral centers comprises no more than 6 internucleotidic linkages in the Rp configuration. In some embodiments, a common pattern of backbone chiral centers comprises no more than 5 internucleotidic linkages in the Rp configuration. In some embodiments, a common pattern of backbone chiral centers comprises no more than 4 internucleotidic linkages in the Rp configuration. In some embodiments, a common pattern of backbone chiral centers comprises no more than 3 internucleotidic linkages in the Rp configuration. In some embodiments, a common pattern of backbone chiral centers comprises no more than 2 internucleotidic linkages in the Rp configuration. In some embodiments, a common pattern of backbone chiral centers comprises no more than 1 internucleotidic linkages in the Rp configuration. In some embodiments, a common pattern of backbone chiral centers comprises no more than 8 internucleotidic linkages which are not chiral (as a non-limiting example, a phosphodiester). In some embodiments, a common pattern of backbone chiral centers comprises no more than 7 internucleotidic linkages which are not chiral. In some embodiments, a common pattern of backbone chiral centers comprises no more than 6 internucleotidic linkages which are not chiral. In some embodiments, a common pattern of backbone chiral centers comprises no more than 5 internucleotidic linkages which are not chiral. In some embodiments, a common pattern of backbone chiral centers comprises no more than 4 internucleotidic linkages which are not chiral. In some embodiments, a common pattern of backbone chiral centers comprises no more than 3 internucleotidic linkages which are not chiral. In some embodiments, a common pattern of backbone chiral centers comprises no more than 2 internucleotidic linkages which are not chiral. In some embodiments, a common pattern of backbone chiral centers comprises no more than 1 internucleotidic linkages which are not chiral. In some embodiments, a common pattern of backbone chiral centers comprises at least 10 internucleotidic linkages in the Sp configuration, and no more than 8 internucleotidic linkages which are not chiral. In some embodiments, a common pattern of backbone chiral centers comprises at least 11 internucleotidic linkages in the Sp configuration, and no more than 7 internucleotidic linkages which are not chiral. In some embodiments, a common pattern of backbone chiral centers comprises at least 12 internucleotidic linkages in the Sp configuration, and no more than 6 internucleotidic linkages which are not chiral. In some embodiments, a common pattern of backbone chiral centers comprises at least 13 internucleotidic linkages in the Sp configuration, and no more than 6 internucleotidic linkages which are not chiral. In some embodiments, a common pattern of backbone chiral centers comprises at least 14 internucleotidic linkages in the Sp configuration, and no more than 5 internucleotidic linkages which are not chiral. In some embodiments, a common pattern of backbone chiral centers comprises at least 15 internucleotidic linkages in the Sp configuration, and no more than 4 internucleotidic linkages which are not chiral. In some embodiments, the internucleotidic linkages in the Sp configuration are optionally contiguous or not contiguous. In some embodiments, the internucleotidic linkages in the Rp configuration are optionally contiguous or not contiguous. In some embodiments, the internucleotidic linkages which are not chiral are optionally contiguous or not contiguous.

In some embodiments, compound of the disclosure comprises a block is a stereochemistry block. In some embodiments, a block is an Rp block in that each internucleotidic linkage of the block is Rp. In some embodiments, a 5'-block is an Rp block. In some embodiments, a 3'-block is an Rp block. In some embodiments, a block is an Sp block in that each internucleotidic linkage of the block is Sp. In some embodiments, a 5'-block is an Sp block. In some embodiments, a 3'-block is an Sp block. In some embodiments, provided oligonucleotides comprise both Rp and Sp blocks. In some embodiments, provided oligonucleotides comprise one or more Rp but no Sp blocks. In some embodiments, provided oligonucleotides comprise one or more Sp but no Rp blocks. In some embodiments, provided oligonucleotides comprise one or more PO blocks wherein each internucleotidic linkage in a natural phosphate linkage.

In some embodiments, compound of the disclosure comprises a 5'-block is an Sp block wherein each sugar moiety comprises a 2'-F modification. In some embodiments, a 5'-block is an Sp block wherein each of internucleotidic linkage is a modified internucleotidic linkage and each sugar moiety comprises a 2'-F modification. In some embodiments, a 5'-block is an Sp block wherein each of internucleotidic linkage is a phosphorothioate linkage and each sugar moiety comprises a 2'-F modification. In some embodiments, a 5'-block comprises 4 or more nucleoside units. In some embodiments, a 5'-block comprises 5 or more nucleoside units. In some embodiments, a 5'-block comprises 6 or more nucleoside units. In some embodiments, a 5'-block comprises 7 or more nucleoside units. In some embodiments, a 3'-block is an Sp block wherein each sugar moiety comprises a 2'-F modification. In some embodiments, a 3'-block is an Sp block wherein each of internucleotidic linkage is a modified internucleotidic linkage and each sugar moiety comprises a 2'-F modification. In some embodiments, a 3'-block is an Sp block wherein each of internucleotidic linkage is a phosphorothioate linkage and each sugar moiety comprises a 2'-F modification. In some embodiments, a 3'-block comprises 4 or more nucleoside units. In some embodiments, a 3'-block comprises 5 or more nucleoside units. In some embodiments, a 3'-block comprises 6 or more nucleoside units. In some embodiments, a 3'-block comprises 7 or more nucleoside units.

In some embodiments, compound of the disclosure comprises a type of nucleoside in a region or an oligonucleotide is followed by a specific type of internucleotidic linkage, e.g., natural phosphate linkage, modified internucleotidic linkage, Rp chiral internucleotidic linkage, Sp chiral internucleotidic linkage, etc. In some embodiments, A is followed by Sp. In some embodiments, A is followed by Rp. In some embodiments, A is followed by natural phosphate linkage (PO). In some embodiments, U is followed by Sp. In some embodiments, U is followed by Rp. In some embodiments, U is followed by natural phosphate linkage (PO). In some embodiments, C is followed by Sp. In some embodiments, C is followed by Rp. In some embodiments, C is followed by natural phosphate linkage (PO). In some embodiments, G is followed by Sp. In some embodiments, G is followed by Rp. In some embodiments, G is followed by natural phosphate linkage (PO). In some embodiments, C and U are followed by Sp. In some embodiments, C and U are followed by Rp. In some embodiments, C and U are followed by natural phosphate linkage (PO). In some embodiments, A and G are followed by Sp. In some embodiments, A and G are followed by Rp.

In some embodiments, the antisense strand comprises phosphorothioate internucleotide linkages between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5 or 6 2'-fluoro modifications; (ii) the antisense comprises 3, 4 or 5 phosphorothioate internucleotide linkages; (iii) the sense strand is conjugated with a ligand; (iv) the sense strand comprises 2, 3, 4 or 5 2'-fluoro modifications; (v) the sense strand comprises 1, 2, 3, 4 or 5 phosphorothioate internucleotide linkages; (vi) the dsRNA comprises at least four 2'-fluoro modifications; (vii) the dsRNA comprises a duplex region of 12-40 nucleotide pairs in length; and (viii) the dsRNA has a blunt end at 5'-end of the antisense strand. In some embodiments, the antisense strand comprises phosphorothioate internucleotide linkages between nucleotide positions 1 and 2, between nucleotide positions 2 and 3, between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5 or 6 2'-fluoro modifications; (ii) the sense strand is conjugated with a ligand; (iii) the sense strand comprises 2, 3, 4 or 5 2'-fluoro modifications; (iv) the sense strand comprises 1, 2, 3, 4 or 5 phosphorothioate internucleotide linkages; (v) the dsRNA comprises at least four 2'-fluoro modifications; (vi) the dsRNA comprises a duplex region of 12-40 nucleotide pairs in length; (vii) the dsRNA comprises a duplex region of 12-40 nucleotide pairs in length; and (viii) the dsRNA has a blunt end at 5'-end of the antisense strand.

In some embodiments, the sense strand comprises phosphorothioate internucleotide linkages between nucleotide positions 1 and 2, and between nucleotide positions 2 and 3, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5 or 6 2'-fluoro modifications; (ii) the antisense comprises 1, 2, 3, 4 or 5 phosphorothioate internucleotide linkages; (iii) the sense strand is conjugated with a ligand; (iv) the sense strand comprises 2, 3, 4 or 5 2'-fluoro modifications; (v) the sense strand comprises 3, 4 or 5 phosphorothioate internucleotide linkages; (vi) the dsRNA comprises at least four 2'-fluoro modifications; (vii) the dsRNA comprises a duplex region of 12-40 nucleotide pairs in length; and (viii) the dsRNA has a blunt end at 5'-end of the antisense strand.

In some embodiments, the sense strand comprises phosphorothioate internucleotide linkages between nucleotide positions 1 and 2, and between nucleotide positions 2 and 3, the antisense strand comprises phosphorothioate internucleotide linkages between nucleotide positions 1 and 2, between nucleotide positions 2 and 3, between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six or all seven) of the following characteristics: (i) the antisense comprises 2, 3, 4, 5 or 6 2'-fluoro modifications; (ii) the sense strand is conjugated with a ligand; (iii) the sense strand comprises 2, 3, 4 or 5 2'-fluoro modifications; (iv) the sense strand comprises 3, 4 or 5 phosphorothioate internucleotide linkages; (v) the dsRNA comprises at least four 2'-fluoro modifications; (vi) the dsRNA comprises a duplex region of 12-40 nucleotide pairs in length; and (vii) the dsRNA has a blunt end at 5'-end of the antisense strand.

In some embodiments, the dsRNA molecule of the disclosure comprises mismatch(es) with the target, within the duplex, or combinations thereof. The mismatch can occur in the overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In some embodiments, the dsRNA molecule of the disclosure comprises at least one of the first 1, 2, 3, 4, or 5 base pairs within the duplex regions from the 5'-end of the antisense strand can be chosen independently from the group of: A:U, G:U, I:C, and mismatched pairs, e.g., non-canonical or other than canonical pairings or pairings which include a universal base, to promote the dissociation of the antisense strand at the 5'-end of the duplex.

In some embodiments, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

It was found that introducing 4'-modified and/or 5'-modified nucleotide to the 3'-end of a phosphodiester (PO), phosphorothioate (PS), and/or phosphorodithioate (PS2) linkage of a dinucleotide at any position of single stranded or double stranded oligonucleotide can exert steric effect to the internucleotide linkage and, hence, protecting or stabilizing it against nucleases.

In some embodiments, 5'-modified nucleoside is introduced at the 3'-end of a dinucleotide at any position of single stranded or double stranded siRNA. For instance, a 5'-alkylated nucleoside may be introduced at the 3'-end of a dinucleotide at any position of single stranded or double stranded siRNA. The alkyl group at the 5' position of the ribose sugar can be racemic or chirally pure R or S isomer. An exemplary 5'-alkylated nucleoside is 5'-methyl nucleoside. The 5'-methyl can be either racemic or chirally pure R or S isomer.

In some embodiments, 4'-modified nucleoside is introduced at the 3'-end of a dinucleotide at any position of single stranded or double stranded siRNA. For instance, a 4'-alkylated nucleoside may be introduced at the 3'-end of a dinucleotide at any position of single stranded or double stranded siRNA. The alkyl group at the 4' position of the ribose sugar can be racemic or chirally pure R or S isomer. An exemplary 4'-alkylated nucleoside is 4'-methyl nucleoside. The 4'-methyl can be either racemic or chirally pure R or S isomer. Alternatively, a 4'-O-alkylated nucleoside may be introduced at the 3'-end of a dinucleotide at any position of single stranded or double stranded siRNA. The 4'-O-alkyl of the ribose sugar can be racemic or chirally pure R or S isomer. An exemplary 4'-O-alkylated nucleoside is 4'-O-methyl nucleoside. The 4'-O-methyl can be either racemic or chirally pure R or S isomer.

In some embodiments, 5'-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 5'-alkylated nucleoside is 5'-methyl nucleoside. The 5'-methyl can be either racemic or chirally pure R or S isomer.

In some embodiments, 4'-alkylated nucleoside is introduced at any position on the sense strand or antisense strand of a dsRNA, and such modification maintains or improves potency of the dsRNA. The 4'-alkyl can be either racemic or chirally pure R or S isomer. An exemplary 4'-alkylated nucleoside is 4'-methyl nucleoside. The 4'-methyl can be either racemic or chirally pure R or S isomer.

In some embodiments, 4'-O-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 4'-O-alkylated nucleoside is 4'-O-methyl nucleoside. The 4'-O-methyl can be either racemic or chirally pure R or S isomer.

In some embodiments, the dsRNA molecule of the disclosure can comprise 2'-5' linkages (with 2'-H, 2'-OH and 2'-OMe and with P=O or P=S). For example, the 2'-5' linkages modifications can be used to promote nuclease resistance or to inhibit binding of the sense to the antisense strand, or can be used at the 5' end of the sense strand to avoid sense strand activation by RISC.

In another embodiment, the dsRNA molecule of the disclosure can comprise L sugars (e.g., L ribose, L-arabinose with 2'-H, 2'-OH and 2'-OMe). For example, these L sugars modifications can be used to promote nuclease resistance or to inhibit binding of the sense to the antisense strand, or can be used at the 5' end of the sense strand to avoid sense strand activation by RISC.

Various publications describe multimeric siRNA which can all be used with the dsRNA of the disclosure. Such publications include WO2007/091269, U.S. Pat. No. 7,858, 769, WO2010/141511, WO2007/117686, WO2009/014887 and WO2011/031520 which are hereby incorporated by their entirely.

The dsRNA molecule that contains conjugations of one or more carbohydrate moieties to a dsRNA molecule can optimize one or more properties of the dsRNA molecule. In many cases, the carbohydrate moiety will be attached to a modified subunit of the dsRNA molecule. E.g., the ribose sugar of one or more ribonucleotide subunits of a dsRNA molecule can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

In one embodiment the dsRNA molecule of the disclosure is conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3] dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

The double-stranded RNA (dsRNA) agent of the disclosure may optionally be conjugated to one or more ligands. The ligand can be attached to the sense strand, antisense strand or both strands, at the 3'-end, 5'-end or both ends. For instance, the ligand may be conjugated to the sense strand, in particular, the 3'-end of the sense strand.

In some embodiments dsRNA molecules of the disclosure are 5' phosphorylated or include a phosphoryl analog at the 5' prime terminus. 5'-phosphate modifications include those which are compatible with RISC mediated gene silencing. Suitable modifications include: 5'-monophosphate ((HO)$_2$(O)P—O-5'); 5'-diphosphate ((HO)$_2$(O)P—O—P(HO)(O)—O-5'); 5'-triphosphate ((HO)$_2$(O)P—O—(HO)(O)P—O—P(HO)(O)—O-5'); 5'-guanosine cap (7-methylated or non-methylated) (7m-G-O-5'-(HO)(O)P—O—(HO)(O)P—O—P(HO)(O)—O-5'); 5'-adenosine cap (Appp), and any modified or unmodified nucleotide cap structure (N—O-5'-(HO)(O)P—O—(HO)(O)P—O—P(HO)(O)—O-5'); 5'-monothiophosphate (phosphorothioate; (HO)$_2$(S)P—O-5'); 5'-monodithiophosphate (phosphorodithioate; (HO)(HS)(S)P—O-5'), 5'-phosphorothiolate ((HO)2(O)P—S-5'); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates ((HO)$_2$(O)P—NH-5', (HO)(NH$_2$)(O)P—O-5'), 5'-alkylphosphonates (R=alkyl=methyl, ethyl, isopropyl, propyl, etc., e.g. RP(OH)(O)—O-5'-, 5'-alkenylphosphonates (i.e. vinyl, substituted vinyl), (OH)$_2$(O)P-5'-CH2-), 5'-alkyletherphosphonates (R=alkylether=methoxymethyl (MeOCH2-), ethoxymethyl, etc., e.g. RP(OH)(O)—O-5'-). In one example, the modification can in placed in the antisense strand of a dsRNA molecule.

F. Linkers

In some embodiments, the conjugate or ligand described herein can be attached to a RNAi agent oligonucleotide with various linkers that can be cleavable or non cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, SO$_2$, SO$_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroary- lalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), SO$_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-17, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-based cleavable linking groups In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In another embodiment, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleaving linking groups have the general formula —NHCHRAC(O)NHCHRBC(O)—, where RA and RB are the R groups of the two adjacent amino acids. These candidates can be evaluated using methods analogous to those described above.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within a RNAi agent. The present disclosure also includes RNAi agents that are chimeric compounds.

"Chimeric" RNAi agents or "chimeras," in the context of this disclosure, are RNAi agents, preferably dsRNAs, which contain two or more chemically distinct regions, each made up of at least one monomer unit, i.e., a nucleotide in the case of a dsRNA compound. These RNAi agents typically contain at least one region wherein the RNA is modified so as to confer upon the RNAi agent increased resistance to nuclease degradation, increased cellular uptake, and/or increased binding affinity for the target nucleic acid. An additional region of the RNAi agent can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of RNAi agent-mediated inhibition of gene expression. Consequently, comparable results can often be obtained with shorter RNAi agents when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of a RNAi agent can be modified by a non-ligand group. A number of non-ligand molecules have been conjugated to RNAi agents in order to enhance the activity, cellular distribution or cellular uptake of the RNAi agent, and procedures for performing such conjugations are available in the scientific literature. Such non-ligand moieties have included lipid moieties, such as cholesterol (Kubo, T. et al., Biochem. Biophys. Res. Comm., 2007, 365(1):54-61; Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-S-tritylthiol (Manoharan et al., Ann. N.Y. Acad. Sci., 1992, 660:306; Manoharan et al., Bioorg. Med. Chem. Lett., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or tri ethyl ammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

VI. Delivery of a RNAi Agent of the Disclosure

The delivery of a RNAi agent of the disclosure to a cell e.g., a cell within a subject, such as a human subject (e.g., a subject in need thereof, such as a subject having an APP-associated disorder, e.g., CAA and/or AD, e.g., EOFAD) can be achieved in a number of different ways. For example, delivery may be performed by contacting a cell with a RNAi agent of the disclosure either in vitro or in vivo. In vivo delivery may also be performed directly by administering a composition comprising a RNAi agent, e.g., a dsRNA, to a subject. Alternatively, in vivo delivery may be performed indirectly by administering one or more vectors that encode and direct the expression of the RNAi agent. These alternatives are discussed further below.

In general, any method of delivering a nucleic acid molecule (in vitro or in vivo) can be adapted for use with a RNAi agent of the disclosure (see e.g., Akhtar S. and Julian R L., (1992) Trends Cell. Biol. 2(5):139-144 and WO94/02595, which are incorporated herein by reference in their entireties). For in vivo delivery, factors to consider in order to deliver a RNAi agent include, for example, biological stability of the delivered agent, prevention of non-specific effects, and accumulation of the delivered agent in the target tissue. The non-specific effects of a RNAi agent can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the RNAi agent to be administered. Several studies have shown successful knockdown of gene products when a RNAi agent is administered locally. For example, intraocular delivery of a VEGF dsRNA by intravitreal injection in cynomolgus monkeys (Tolentino, M J. et al., (2004) Retina 24:132-138) and subretinal injections in mice (Reich, S J. et al. (2003) Mol. Vis. 9:210-216) were both shown to prevent neovascularization in an experimental model of age-related macular degeneration. In addition, direct intratumoral injection of a dsRNA in mice reduces tumor volume (Pille, J. et al. (2005) Mol. Ther. 11:267-274) and can prolong survival of tumor-bearing mice (Kim, W J. et al., (2006) Mol. Ther. 14:343-350; Li, S. et al., (2007) Mol. Ther. 15:515-523). RNA interference has also shown success with local delivery to the CNS by direct injection (Dorn, G. et al., (2004) Nucleic Acids 32:e49; Tan, P H. et al. (2005) Gene Ther. 12:59-66; Makimura, H. et al. (2002) BMC Neurosci. 3:18; Shishkina, G T., et al. (2004) Neuroscience 129:521-528; Thakker, E R., et al. (2004) Proc. Natl. Acad. Sci. U.S.A. 101:17270-17275; Akaneya, Y., et al. (2005) J. Neurophysiol. 93:594-602) and to the lungs by intranasal administration (Howard, K A. et al., (2006) Mol. Ther. 14:476-484; Zhang, X. et al., (2004) J. Biol. Chem. 279: 10677-10684; Bitko, V. et al., (2005) Nat. Med. 11:50-55). For administering a RNAi agent systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the RNAi agent to the target tissue and avoid undesirable off-target effects (e.g., without wishing to be bound by theory, use of GNAs as described herein has been identified to destabilize the seed region of a dsRNA, resulting in enhanced preference of such dsRNAs for on-target effectiveness, relative to off-target effects, as such off-target effects are significantly weakened by such seed region destabilization). RNAi agents can be modified by chemical conjugation to lipophilic groups such as cholesterol to enhance cellular uptake and prevent degradation. For example, a RNAi agent directed against ApoB conjugated to a lipophilic cholesterol moiety was injected systemically into mice and resulted in knockdown of apoB mRNA in both the liver and jejunum (Soutschek, J. et al., (2004) Nature 432:173-178). Conjugation of a RNAi agent to an aptamer has been shown to inhibit tumor growth and mediate tumor regression in a mouse model of prostate cancer (McNamara, J O. et al., (2006) *Nat. Biotechnol.* 24:1005-1015). In an alternative embodiment, the RNAi agent can be delivered using drug delivery systems such as a nanoparticle, a dendrimer, a polymer, liposomes, or a cationic delivery system. Positively charged cationic delivery systems facilitate binding of molecule RNAi agent (negatively charged) and also enhance interactions at the negatively charged cell membrane to permit efficient uptake of a RNAi agent by the cell. Cationic lipids, dendrimers, or polymers can either be bound to a RNAi agent, or induced to form a vesicle or micelle (see e.g., Kim S H. et al., (2008) *Journal of Controlled Release* 129(2):107-116) that encases a RNAi agent. The formation of vesicles or micelles further prevents degradation of the RNAi agent when administered systemically. Methods for making and administering cat-ionic-RNAi agent complexes are well within the abilities of one skilled in the art (see e.g., Sorensen, D R., et al. (2003) *J. Mol. Biol* 327:761-766; Verma, U N. et al., (2003) *Clin. Cancer Res.* 9:1291-1300; Arnold, A S et al. (2007) *J. Hypertens.* 25:197-205, which are incorporated herein by reference in their entirety). Some non-limiting examples of drug delivery systems useful for systemic delivery of RNAi agents include DOTAP (Sorensen, D R., et al (2003), supra; Verma, U N. et al., (2003), supra), Oligofectamine, "solid nucleic acid lipid particles" (Zimmermann, T S. et al., (2006) *Nature* 441:111-114), cardiolipin (Chien, P Y. et al., (2005) *Cancer Gene Ther.* 12:321-328; Pal, A. et al., (2005) *Int J. Oncol.* 26:1087-1091), polyethyleneimine (Bonnet M E. et al., (2008) *Pharm. Res. August* 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A. et al., (2007) *Biochem. Soc. Trans.* 35:61-67; Yoo, H. et al., (1999) *Pharm. Res.* 16:1799-1804). In some embodiments, a RNAi agent forms a complex with cyclodextrin for systemic administration. Methods for administration and pharmaceutical compositions of RNAi agents and cyclodextrins can be found in U.S. Pat. No. 7,427,605, which is herein incorporated by reference in its entirety.

Certain aspects of the instant disclosure relate to a method of reducing the expression of an APP target gene in a cell, comprising contacting said cell with the double-stranded RNAi agent of the disclosure. In one embodiment, the cell is an extraheptic cell, optionally a CNS cell.

Another aspect of the disclosure relates to a method of reducing the expression of an APP target gene in a subject, comprising administering to the subject the double-stranded RNAi agent of the disclosure.

Another aspect of the disclosure relates to a method of treating a subject having a CNS disorder, comprising administering to the subject a therapeutically effective amount of the double-stranded APP-targeting RNAi agent of the disclosure, thereby treating the subject. Exemplary CNS disorders that can be treated by the method of the disclosure include alzheimer, amyotrophic lateral schlerosis (ALS), frontotemporal dementia, huntington, Parkinson, spinocerebellar, prion, and lafora.

In one embodiment, the double-stranded RNAi agent is administered intrathecally. By intrathecal administration of the double-stranded RNAi agent, the method can reduce the expression of an APP target gene in a brain or spine tissue, for instance, cortex, cerebellum, striatum, cervical spine, lumbar spine, and thoracic spine.

For ease of exposition the formulations, compositions and methods in this section are discussed largely with regard to modified siRNA compounds. It may be understood, however, that these formulations, compositions and methods can be practiced with other siRNA compounds, e.g., unmodified siRNA compounds, and such practice is within the disclosure. A composition that includes a RNAi agent can be delivered to a subject by a variety of routes. Exemplary routes include: intrathecal, intravenous, topical, rectal, anal, vaginal, nasal, pulmonary, ocular.

The RNAi agents of the disclosure can be incorporated into pharmaceutical compositions suitable for administration. Such compositions typically include one or more species of RNAi agent and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The pharmaceutical compositions of the present disclosure may be administered in a number of ways depending upon whether local or systemic treatment is desired and upon the area to be treated. Administration may be topical (including ophthalmic, vaginal, rectal, intranasal, transdermal), oral or parenteral. Parenteral administration includes intravenous drip, subcutaneous, intraperitoneal or intramuscular injection, or intrathecal or intraventricular administration.

The route and site of administration may be chosen to enhance targeting. For example, to target muscle cells, intramuscular injection into the muscles of interest would be a logical choice. Lung cells might be targeted by administering the RNAi agent in aerosol form. The vascular endothelial cells could be targeted by coating a balloon catheter with the RNAi agent and mechanically introducing the DNA.

Formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful.

Compositions for oral administration include powders or granules, suspensions or solutions in water, syrups, elixirs or non-aqueous media, tablets, capsules, lozenges, or troches. In the case of tablets, carriers that can be used include lactose, sodium citrate and salts of phosphoric acid. Various disintegrants such as starch, and lubricating agents such as magnesium stearate, sodium lauryl sulfate and talc, are commonly used in tablets. For oral administration in capsule form, useful diluents are lactose and high molecular weight polyethylene glycols. When aqueous suspensions are required for oral use, the nucleic acid compositions can be combined with emulsifying and suspending agents. If desired, certain sweetening and/or flavoring agents can be added.

Compositions for intrathecal or intraventricular administration may include sterile aqueous solutions which may also contain buffers, diluents and other suitable additives.

Formulations for parenteral administration may include sterile aqueous solutions which may also contain buffers, diluents and other suitable additives. Intraventricular injection may be facilitated by an intraventricular catheter, for example, attached to a reservoir. For intravenous use, the total concentration of solutes may be controlled to render the preparation isotonic.

In one embodiment, the administration of the siRNA compound, e.g., a double-stranded siRNA compound, or ssiRNA compound, composition is parenteral, e.g., intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral or ocular. Administration can be provided by the subject or by another person, e.g., a health care provider. The medication can be provided in measured doses or in a dispenser which delivers a metered dose. Selected modes of delivery are discussed in more detail below.

Intrathecal Administration.

In one embodiment, the double-stranded RNAi agent is delivered by intrathecal injection (i.e. injection into the spinal fluid which bathes the brain and spinal chord tissue). Intrathecal injection of RNAi agents into the spinal fluid can be performed as a bolus injection or via minipumps which can be implanted beneath the skin, providing a regular and constant delivery of siRNA into the spinal fluid. The circulation of the spinal fluid from the choroid plexus, where it is produced, down around the spinal chord and dorsal root ganglia and subsequently up past the cerebellum and over the cortex to the arachnoid granulations, where the fluid can exit the CNS, that, depending upon size, stability, and solubility of the compounds injected, molecules delivered intrathecally could hit targets throughout the entire CNS.

In some embodiments, the intrathecal administration is via a pump. The pump may be a surgically implanted osmotic pump. In one embodiment, the osmotic pump is implanted into the subarachnoid space of the spinal canal to facilitate intrathecal administration.

In some embodiments, the intrathecal administration is via an intrathecal delivery system for a pharmaceutical including a reservoir containing a volume of the pharmaceutical agent, and a pump configured to deliver a portion of the pharmaceutical agent contained in the reservoir. More details about this intrathecal delivery system may be found in PCT/US2015/013253, filed on Jan. 28, 2015, which is incorporated by reference in its entirety.

The amount of intrathecally injected RNAi agents may vary from one target gene to another target gene and the appropriate amount that has to be applied may have to be determined individually for each target gene. Typically, this amount ranges between 10 μg to 2 mg, preferably 50 μg to 1500 more preferably 100 μg to 1000 μg.

A. Vector Encoded RNAi Agents of the Disclosure

RNAi agents targeting the APP gene can be expressed from transcription units inserted into DNA or RNA vectors (see, e.g., Couture, A, et al., *TIG*. (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., (1995) *Proc. Natl. Acad. Sci. USA* 92:1292).

The individual strand or strands of a RNAi agent can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

RNAi agent expression vectors are generally DNA plasmids or viral vectors. Expression vectors compatible with eukaryotic cells, preferably those compatible with vertebrate cells, can be used to produce recombinant constructs for the expression of a RNAi agent as described herein. Eukaryotic cell expression vectors are well known in the art and are available from a number of commercial sources. Typically, such vectors are provided containing convenient restriction sites for insertion of the desired nucleic acid segment. Delivery of RNAi agent expressing vectors can be systemic, such as by intravenous or intramuscular administration, by administration to target cells ex-planted from the patient followed by reintroduction into the patient, or by any other means that allows for introduction into a desired target cell.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of a RNAi agent will generally require regulatory elements, e.g., promoters, enhancers, etc., to ensure the expression of the RNAi agent in target cells. Other aspects to consider for vectors and constructs are known in the art.

VII. Pharmaceutical Compositions of the Disclosure

The present disclosure also includes pharmaceutical compositions and formulations which include the RNAi agents of the disclosure. In one embodiment, provided herein are pharmaceutical compositions containing a RNAi agent, as described herein, and a pharmaceutically acceptable carrier. The pharmaceutical compositions containing the RNAi agent are useful for treating a disease or disorder associated with the expression or activity of an APP gene, e.g., an APP-associated disease, e.g., CAA or AD, e.g., EOFAD.

Such pharmaceutical compositions are formulated based on the mode of delivery. One example is compositions that are formulated for systemic administration via parenteral delivery, e.g., by intravenous (IV), intramuscular (IM), or for subcutaneous (subQ) delivery. Another example is compositions that are formulated for direct delivery into the CNS, e.g., by intrathecal or intravitreal routes of injection, optionally by infusion into the brain, such as by continuous pump infusion.

The pharmaceutical compositions of the disclosure may be administered in dosages sufficient to inhibit expression of an APP gene. In general, a suitable dose of a RNAi agent of the disclosure will be in the range of about 0.001 to about 200.0 milligrams per kilogram body weight of the recipient per day, generally in the range of about 1 to 50 mg per kilogram body weight per day. Typically, a suitable dose of a RNAi agent of the disclosure will be in the range of about 0.1 mg/kg to about 5.0 mg/kg, preferably about 0.3 mg/kg and about 3.0 mg/kg.

A repeat-dose regimen may include administration of a therapeutic amount of a RNAi agent on a regular basis, such as bi-monthly or monthly to once a year. In certain embodiments, the RNAi agent is administered about once per month to about once per quarter (i.e., about once every three months).

After an initial treatment regimen, the treatments can be administered on a less frequent basis.

The dosage unit can be compounded for delivery over an extended period, e.g., using a conventional sustained release formulation which provides sustained release of the RNAi agent over an extended period. Sustained release formulations are well known in the art and are particularly useful for delivery of agents at a particular site, such as could be used with the agents of the present disclosure. In this embodiment, the dosage unit contains a corresponding multiple of, e.g., a monthlydose.

In other embodiments, a single dose of the pharmaceutical compositions can be long lasting, such that subsequent doses are administered at not more than 1, 2, 3, or 4 or more week intervals. In some embodiments of the disclosure, a single dose of the pharmaceutical compositions of the disclosure is administered once per week. In other embodiments of the disclosure, a single dose of the pharmaceutical compositions of the disclosure is administered bi-monthly.

The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual RNAi agents encompassed by the disclosure can be made using conventional methodologies or on the basis of in vivo testing using an appropriate animal model, as described elsewhere herein.

Advances in mouse genetics have generated a number of mouse models for the study of various human diseases, such as APP-associated disorders that would benefit from reduction in the expression of APP. Such models can be used for in vivo testing of RNAi agents, as well as for determining a therapeutically effective dose. Suitable mouse models are known in the art and include, for example, the AD and/or CAA models described elsewhere herein.

The pharmaceutical compositions of the present disclosure can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The RNAi agents can be delivered in a manner to target a particular tissue, such as the CNS (e.g., neuronal, glial and/or vascular tissue of the brain).

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the RNAi agents featured in the disclosure are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). RNAi agents featured in the disclosure can be encapsulated within liposomes or can form complexes thereto, in particular to cationic liposomes. Alternatively, RNAi agents can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

A. RNAi Agent Formulations Comprising Membranous Molecular Assemblies

A RNAi agent for use in the compositions and methods of the disclosure can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the RNAi agent composition. The lipophilic material isolates the aqueous interior from an aqueous exterior, which typically does not include the RNAi agent composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the RNAi agent are delivered into the cell where the RNAi agent can specifically bind to a target RNA and can mediate RNAi. In some cases the liposomes are also specifically targeted, e.g., to direct the RNAi agent to particular cell types.

A liposome containing a RNAi agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The RNAi agent preparation is then added to the micelles that include the lipid component. The cationic groups on the lipid interact with the RNAi agent and condense around the RNAi agent to form a liposome. After condensation, the detergent is removed, e.g., by dialysis, to yield a liposomal preparation of RNAi agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., (1987) *Proc. Natl. Acad. Sci. USA* 8:7413-7417; U.S. Pat. Nos. 4,897,355; 5,171,678; Bangham et al., (1965) *M Mol. Biol.* 23:238; Olson et al., (1979) *Biochim. Biophys. Acta* 557:9; Szoka et al., (1978) *Proc. Natl. Acad. Sci.* 75: 4194; Mayhew et al., (1984) *Biochim. Biophys. Acta* 775:169; Kim et al., (1983) *Biochim. Biophys. Acta* 728:339; and Fukunaga et al., (1984) *Endocrinol.* 115:757. Commonly used techniques for preparing lipid aggregates of appropriate size for use as delivery vehicles include sonication and freeze-thaw plus extrusion (see, e.g., Mayer et al., (1986) *Biochim. Biophys. Acta* 858:161. Microfluidization can be used when consistently small (50 to 200 nm) and relatively uniform aggregates are desired (Mayhew et al., (1984) *Biochim. Biophys. Acta* 775:169. These methods are readily adapted to packaging RNAi agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al. (1987) *Biochem. Biophys. Res. Commun.*, 147:980-985).

Liposomes, which are pH-sensitive or negatively charged, entrap nucleic acids rather than complex with them. Since both the nucleic acid and the lipid are similarly charged, repulsion rather than complex formation occurs. Nevertheless, some nucleic acid is entrapped within the aqueous interior of these liposomes. pH sensitive liposomes have been used to deliver nucleic acids encoding the thymidine kinase gene to cell monolayers in culture. Expression of the exogenous gene was detected in the target cells (Zhou et al. (1992) *Journal of Controlled Release,* 19:269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. Nos. 5,283,185; 5,171,678; WO 94/00569; WO 93/24640; WO 91/16024; Felgner, (1994) *J. Biol. Chem.* 269:2550; Nabel, (1993) *Proc. Natl. Acad. Sci.* 90:11307; Nabel, (1992) *Human Gene Ther.* 3:649; Gershon, (1993) *Biochem.* 32:7143; and Strauss, (1992) *EMBO J.* 11:417.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al., (1994) *S.T.P. Pharma. Sci.,* 4(6):466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., (1987) *FEBS Letters,* 223:42; Wu et al., (1993) *Cancer Research,* 53:3765).

Various liposomes comprising one or more glycolipids are known in the art. Papahadjopoulos et al. (*Ann. N.Y. Acad. Sci.*, (1987), 507:64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, (1988), 85:6949). U.S. Pat. No. 4,837,028 and WO 88/04924, both to Allen et al., disclose liposomes comprising (1) sphingomyelin and (2) the ganglioside Gm' or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver RNAi agents to macrophages.

Further advantages of liposomes include: liposomes obtained from natural phospholipids are biocompatible and biodegradable; liposomes can incorporate a wide range of water and lipid soluble drugs; liposomes can protect encapsulated RNAi agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of RNAi agent (see, e.g., Felgner, P. L. et al., (1987) Proc. Natl. Acad. Sci. USA 8:7413-7417, and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wis.) and dipalmitoylphosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., (1991) Biochim. Biophys. Res. Commun. 179:280). Lipopolylysine, made by conjugating polylysine to DOPE, has been reported to be effective for transfection in the presence of serum (Zhou, X. et al., (1991) Biochim. Biophys. Acta 1065:8). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer RNAi agent into the skin. In some implementations, liposomes are used for delivering RNAi agent to epidermal cells and also to enhance the penetration of RNAi agent into dermal tissues, e.g., into skin. For example, the liposomes can be applied topically. Topical delivery of drugs formulated as liposomes to the skin has been documented (see, e.g., Weiner et al., (1992) Journal of Drug Targeting, vol. 2, 405-410 and du Plessis et al., (1992) Antiviral Research, 18:259-265; Mannino, R. J. and Fould-Fogerite, S., (1998) Biotechniques 6:682-690; Itani, T. et al., (1987) Gene 56:267-276; Nicolau, C. et al. (1987) Meth. Enzymol. 149: 157-176; Straubinger, R. M. and Papahadjopoulos, D. (1983) Meth. Enzymol. 101:512-527; Wang, C. Y. and Huang, L., (1987) Proc. Natl. Acad. Sci. USA 84:7851-7855).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with RNAi agent are useful for treating a dermatological disorder.

Liposomes that include RNAi agents can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include RNAi agent can be delivered, for example, subcutaneously by infection in order to deliver RNAi agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present disclosure are described in U.S. provisional application Ser. No. 61/018, 616, filed Jan. 2, 2008; 61/018,611, filed Jan. 2, 2008; 61/039,748, filed Mar. 26, 2008; 61/047,087, filed Apr. 22, 2008 and 61/051,528, filed May 8, 2008. PCT application no PCT/US2007/080331, filed Oct. 3, 2007 also describes formulations that are amenable to the present disclosure.

Transfersomes are yet another type of liposomes, and are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as those described herein, particularlay in emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides. The use of surfactants in drug products, formulations and in emulsions has been reviewed (Rieger, in Pharmaceutical Dosage Forms, Marcel Dekker, Inc., New York, N.Y., 1988, p. 285).

The RNAi agent for use in the methods of the disclosure can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

Lipid Particles

RNAi agents, e.g., dsRNAs of in the disclosure may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No. WO 00/03683. The particles of the present disclosure typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present disclosure are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; U.S. Publication No. 2010/0324120 and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the disclosure.

Certain specific LNP formulations for delivery of RNAi agents have been described in the art, including, e.g., "LNP01" formulations as described, e.g., in International Application Publication No. WO 2008/042973, which is hereby incorporated by reference.

Additional exemplary lipid-dsRNA formulations are identified in the table below.

|       | Ionizable/Cationic Lipid | cationic lipid/non-cationic lipid/cholesterol/PEG-lipid conjugate Lipid:siRNA ratio |
|-------|--------------------------|---------------------------------------------------------------------------------------|
| SNALP-1 | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA~7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |

| | Ionizable/Cationic Lipid | cationic lipid/non-cationic lipid/<br>cholesterol/PEG-lipid conjugate<br>Lipid:siRNA ratio |
|---|---|---|
| LNP22 | XTC | XTC/DSPC/Chol/PEG-DSG<br>50/10/38.5/1.5<br>Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000)
SNALP (1,2-Dilinolenyloxy-N,N-dimethylaminopropane (DLinDMA)) comprising formulations are described in International Publication No. W02009/127060, filed Apr. 15, 2009, which is hereby incorporated by reference.
XTC comprising formulations are described in PCT Publication No. WO 2010/088537, the entire contents of which are hereby incorporated herein by reference.
MC3 comprising formulations are described, e.g., in U.S. Publication No. 2010/0324120, filed Jun. 10, 2010, the entire contents of which are hereby incorporated by reference.
ALNY-100 comprising formulations are described in PCT Publication No. WO 2010/054406, the entire contents of which are hereby incorporated herein by reference.
C12-200 comprising formulations are described in PCT Publication No. WO 2010/129709, the entire contents of which are hereby incorporated herein by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the disclosure are administered in conjunction with one or more penetration enhancer surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the disclosure can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present disclosure include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the brain when treating APP-associated diseases or disorders.

The pharmaceutical formulations of the present disclosure, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present disclosure can be formulated into any of many possible dosage forms such as, but not limited to, tablets, capsules, gel capsules, liquid syrups, soft gels, suppositories, and enemas. The compositions of the present disclosure can also be formulated as suspensions in aqueous, non-aqueous or mixed media. Aqueous suspensions can further contain substances which increase the viscosity of the suspension including, for example, sodium carboxymethylcellulose, sorbitol and/or dextran. The suspension can also contain stabilizers.

Additional Formulations i. Emulsions

The compositions of the present disclosure can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich NG., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, LV., Popovich NG., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present disclosure, the compositions of RNAi agents and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191, 105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or RNAi agents.

Microemulsions have also been effective in the transdermal delivery of active components in both cosmetic and pharmaceutical applications. It is expected that the microemulsion compositions and formulations of the present disclosure will facilitate the increased systemic absorption of RNAi agents and nucleic acids from the gastrointestinal tract, as well as improve the local cellular uptake of RNAi agents and nucleic acids.

Microemulsions of the present disclosure can also contain additional components and additives such as sorbitan monostearate (Grill 3), Labrasol, and penetration enhancers to improve the properties of the formulation and to enhance the absorption of the RNAi agents and nucleic acids of the present disclosure. Penetration enhancers used in the microemulsions of the present disclosure can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An RNAi agent of the disclosure may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present disclosure employs various penetration enhancers to effect the efficient delivery of nucleic acids, particularly RNAi agents, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of RNAi agents through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, N.Y., 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acyl cholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, Mass., 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present disclosure, can be defined as compounds that remove metallic ions from solution by forming complexes therewith, with the result that absorption of RNAi agents through the mucosa is enhanced. With regards to their use as penetration enhancers in the present disclosure, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, Mass., 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

As used herein, non-chelating non-surfactant penetration enhancing compounds can be defined as compounds that demonstrate insignificant activity as chelating agents or as surfactants but that nonetheless enhance absorption of RNAi agents through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of RNAi agents at the cellular level can also be added to the pharmaceutical and other compositions of the present disclosure. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, Calif.), Lipofectamine 2000™ (Invitrogen; Carlsbad, Calif.), 293Fectin™ (Invitrogen; Carlsbad, Calif.), Cellfectin™ (Invitrogen; Carlsbad, Calif.), DMRIE- C™ (Invitrogen; Carlsbad, Calif.), FreeStyle™ MAX (Invitrogen; Carlsbad, Calif.), Lipofectamine™ 2000 CD (Invitrogen; Carlsbad, Calif.), Lipofectamine™ (Invitrogen; Carlsbad, Calif.), RNAiMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfx™-20 Reagent (Promega; Madison, Wis.), Tfx™-50 Reagent (Promega; Madison, Wis.), DreamFect™ (OZ Biosciences; Marseille, France), EcoTransfect (OZ Biosciences; Marseille, France), TransPass$^a$ D1 Transfection Reagent (New England Biolabs; Ipswich, Mass., USA), LyoVec™/LipoGen™ (Invitrogen; San Diego, Calif., USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTER™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif., USA), SureFECTOR (B-Bridge International; Mountain View, Calif., USA), or HiFect™ (B-Bridge International, Mountain View, Calif., USA), among others.

Other agents can be utilized to enhance the penetration of the administered nucleic acids, including glycols such as ethylene glycol and propylene glycol, pyrrols such as 2-pyrrol, azones, and terpenes such as limonene and menthone.

v. Carriers

Certain compositions of the present disclosure also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present disclosure. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present disclosure can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present disclosure, such as dyes, flavoring agents, preservatives, antioxidants, opacifiers, thickening agents and stabilizers. However, such materials, when added, should not unduly interfere with the biological activities of the components of the compositions of the present disclosure. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions can contain substances which increase the viscosity of the suspension including, for example, sodium carboxymethylcellulose, sorbitol and/or dextran. The suspension can also contain stabilizers.

In some embodiments, pharmaceutical compositions featured in the disclosure include (a) one or more RNAi agents and (b) one or more agents which function by a non-RNAi mechanism and which are useful in treating an APP-associated disorder. Examples of such agents include, but are not limited to an anti-inflammatory agent, anti-steatosis agent, anti-viral, and/or anti-fibrosis agent, or other agent included to treat AD (including EOFAD) and/or CAA in a subject.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds that exhibit high therapeutic indices are preferred.

The data obtained from cell culture assays and animal studies can be used in formulating a range of dosage for use in humans. The dosage of compositions featured herein in the disclosure lies generally within a range of circulating concentrations that include the $ED_{50}$ with little or no toxicity. The dosage can vary within this range depending upon the dosage form employed and the route of administration utilized. For any compound used in the methods featured in the disclosure, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the RNAi agents featured in the disclosure can be administered in combination with other known agents effective in treatment of pathological processes mediated by APP expression. In any event, the administering physician can adjust the amount and timing of RNAi agent administration on the basis of results observed using standard measures of efficacy known in the art or described herein.

VIII. Kits

In certain aspects, the instant disclosure provides kits that include a suitable container containing a pharmaceutical formulation of a siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof). In certain embodiments the individual components of the pharmaceutical formulation may be provided in one container. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

IX. Methods for Inhibiting APP Expression

The present disclosure also provides methods of inhibiting expression of an APP gene in a cell. The methods include contacting a cell with an RNAi agent, e.g., double stranded RNAi agent, in an amount effective to inhibit expression of APP in the cell, thereby inhibiting expression of APP in the cell. In certain embodiments of the disclosure, APP is inhibited preferentially in CNS (e.g., brain) cells.

Contacting of a cell with a RNAi agent, e.g., a double stranded RNAi agent, may be done in vitro or in vivo. Contacting a cell in vivo with the RNAi agent includes contacting a cell or group of cells within a subject, e.g., a human subject, with the RNAi agent. Combinations of in vitro and in vivo methods of contacting a cell are also possible.

Contacting a cell may be direct or indirect, as discussed above. Furthermore, contacting a cell may be accomplished via a targeting ligand, including any ligand described herein or known in the art. In some embodiments, the targeting ligand is a carbohydrate moiety, e.g., a C16 ligand, or any other ligand that directs the RNAi agent to a site of interest.

The term "inhibiting," as used herein, is used interchangeably with "reducing," "silencing," "downregulating," "suppressing" and other similar terms, and includes any level of inhibition. In certain embodiments, a level of inhibition, e.g., for a RNAi agent of the instant disclosure, can be assessed in cell culture conditions, e.g., wherein cells in cell culture are transfected via Lipofectamine™-mediated transfection at a concentration in the vicinity of a cell of 10 nM or less, 1 nM or less, etc. Knockdown of a given RNAi agent can be determined via comparison of pre-treated levels in cell culture versus post-treated levels in cell culture, optionally also comparing against cells treated in parallel with a scrambled or other form of control RNAi agent. Knockdown in cell culture of, e.g., at least 10% or more, at least 20% or more, etc. can thereby be identified as indicative of "inhibiting" and/or "reducing", "downregulating" or "suppressing", etc. having occurred. It is expressly contemplated that assessment of targeted mRNA and/or encoded protein levels (and therefore an extent of "inhibiting", etc. caused by a RNAi agent of the disclosure) can also be assessed in in vivo systems for the RNAi agents of the instant disclosure, under properly controlled conditions as described in the art.

The phrase "inhibiting expression of an APP," as used herein, includes inhibition of expression of any APP gene (such as, e.g., a mouse APP gene, a rat APP gene, a monkey APP gene, or a human APP gene) as well as variants or mutants of an APP gene that encode an APP protein. Thus, the APP gene may be a wild-type APP gene, a mutant APP gene, or a transgenic APP gene in the context of a genetically manipulated cell, group of cells, or organism.

"Inhibiting expression of an APP gene" includes any level of inhibition of an APP gene, e.g., at least partial suppression of the expression of an APP gene, such as an inhibition by at least about 20%. In certain embodiments, inhibition is by at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

The expression of an APP gene may be assessed based on the level of any variable associated with APP gene expression, e.g., APP mRNA level or APP protein level (including APP cleavage products). The expression of an APP may also be assessed indirectly based on the levels of APP-associated biomarkers as described herein.

Inhibition may be assessed by a decrease in an absolute or relative level of one or more of these variables compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In certain embodiments, surrogate markers can be used to detect inhibition of APP. For example, effective prevention or treatment of an APP-associated disorder, e.g., a CNS disorder such as EOFAD, CAA or other disorder, as demonstrated by acceptable diagnostic and monitoring criteria with an agent to reduce APP expression can be understood to demonstrate a clinically relevant reduction in APP.

In some embodiments of the methods of the disclosure, expression of an APP gene is inhibited by at least 20%, a 25%, 30%, 35%, 40%, 45%, 50%, 55%, 60%, 65%, 70%, 75%, 80%, 85%, 90%, or 95%, or to below the level of detection of the assay. In certain embodiments, the methods include a clinically relevant inhibition of expression of APP, e.g. as demonstrated by a clinically relevant outcome after treatment of a subject with an agent to reduce the expression of APP.

Inhibition of the expression of an APP gene may be manifested by a reduction of the amount of mRNA expressed by a first cell or group of cells (such cells may be present, for example, in a sample derived from a subject) in which an APP gene is transcribed and which has or have been treated (e.g., by contacting the cell or cells with a RNAi agent of the disclosure, or by administering a RNAi agent of the disclosure to a subject in which the cells are or were present) such that the expression of an APP gene is inhibited, as compared to a second cell or group of cells substantially identical to the first cell or group of cells but which has not or have not been so treated (control cell(s) not treated with a RNAi agent or not treated with a RNAi agent targeted to the gene of interest). The degree of inhibition may be expressed in terms of:

$$\frac{(mRNA \text{ in control cells}) - (mRNA \text{ in treated cells})}{(mRNA \text{ in control cells})} \cdot 100\%$$

In other embodiments, inhibition of the expression of an APP gene may be assessed in terms of a reduction of a parameter that is functionally linked to APP gene expression, e.g., APP protein expression, formation and/or levels of APP cleavage products, or APP signaling pathways. APP gene silencing may be determined in any cell expressing APP, either endogenous or heterologous from an expression construct, and by any assay known in the art.

Inhibition of the expression of an APP protein may be manifested by a reduction in the level of the APP protein that is expressed by a cell or group of cells (e.g., the level of protein expressed in a sample derived from a subject). As explained above, for the assessment of mRNA suppression, the inhibition of protein expression levels in a treated cell or group of cells may similarly be expressed as a percentage of the level of protein in a control cell or group of cells.

A control cell or group of cells that may be used to assess the inhibition of the expression of an APP gene includes a cell or group of cells that has not yet been contacted with a RNAi agent of the disclosure. For example, the control cell or group of cells may be derived from an individual subject (e.g., a human or animal subject) prior to treatment of the subject with an RNAi agent.

The level of APP mRNA that is expressed by a cell or group of cells may be determined using any method known in the art for assessing mRNA expression. In one embodiment, the level of expression of APP in a sample is determined by detecting a transcribed polynucleotide, or portion thereof, e.g., mRNA of the APP gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene (PreAnalytix, Switzerland). Typical assay formats utilizing ribonucleic acid hybridization include nuclear run-on assays, RT-PCR, RNase protection assays, northern blotting, in situ hybridization, and microarray analysis. Circulating APP mRNA may be detected using methods the described in PCT Publication WO2012/177906, the entire contents of which are hereby incorporated herein by reference.

In some embodiments, the level of expression of APP is determined using a nucleic acid probe. The term "probe", as used herein, refers to any molecule that is capable of selectively binding to a specific APP. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to APP mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in determining the level of APP mRNA.

An alternative method for determining the level of expression of APP in a sample involves the process of nucleic acid amplification and/or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the disclosure, the level of expression of APP is determined by quantitative fluorogenic RT-PCR (i.e., the TaqMan™ System), by a Dual-Glo® Luciferase assay, or by other art-recognized method for measurement of APP expression and/or mRNA level.

The expression levels of APP mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of APP expression level may also comprise using nucleic acid probes in solution.

In some embodiments, the level of mRNA expression is assessed using branched DNA (bDNA) assays or real time PCR (qPCR). The use of this PCR method is described and exemplified in the Examples presented herein. Such methods can also be used for the detection of APP nucleic acids, SREBP nucleic acids or PNPLA3 nucleic acids.

The level of APP protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like. Such assays can also be used for the detection of proteins indicative of the presence or replication of APP proteins, APP cleavage products, or other proteins associated with APP, e.g., PSEN1, PSEN2, etc.

In some embodiments, the efficacy of the methods of the disclosure in the treatment of an APP-related disease is assessed by a decrease in APP mRNA level (e.g, by assessment of a CSF sample for Aβ levels, by brain biopsy, or otherwise).

In some embodiments of the methods of the disclosure, the RNAi agent is administered to a subject such that the RNAi agent is delivered to a specific site within the subject. The inhibition of expression of APP may be assessed using measurements of the level or change in the level of APP mRNA or APP protein in a sample derived from a specific site within the subject, e.g., CNS cells. In certain embodiments, the methods include a clinically relevant inhibition of expression of APP, e.g. as demonstrated by a clinically relevant outcome after treatment of a subject with an agent to reduce the expression of APP.

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

X. Methods of Treating or Preventing APP-Associated Diseases

The present disclosure also provides methods of using a RNAi agent of the disclosure and/or a composition containing a RNAi agent of the disclosure to reduce and/or inhibit APP expression in a cell. The methods include contacting the cell with a dsRNA of the disclosure and maintaining the cell for a time sufficient to obtain degradation of the mRNA transcript of an APP gene, thereby inhibiting expression of the APP gene in the cell. Reduction in gene expression can be assessed by any methods known in the art. For example, a reduction in the expression of APP may be determined by determining the mRNA expression level of APP using methods routine to one of ordinary skill in the art, e.g., Northern blotting, qRT-PCR; by determining the protein level of APP using methods routine to one of ordinary skill in the art, such as Western blotting, immunological techniques. A reduction in the expression of APP may also be assessed indirectly by measuring a decrease in the levels of a soluble cleavage product of APP, e.g., a decrease in the level of soluble APPα, APPβ and/or a soluble Aβ peptide, optionally in a CSF sample of a subject.

In the methods of the disclosure the cell may be contacted in vitro or in vivo, i.e., the cell may be within a subject.

A cell suitable for treatment using the methods of the disclosure may be any cell that expresses an APP gene. A cell suitable for use in the methods of the disclosure may be a mammalian cell, e.g., a primate cell (such as a human cell or a non-human primate cell, e.g., a monkey cell or a chimpanzee cell), a non-primate cell (such as a cow cell, a pig cell, a camel cell, a llama cell, a horse cell, a goat cell, a rabbit cell, a sheep cell, a hamster, a guinea pig cell, a cat cell, a dog cell, a rat cell, a mouse cell, a lion cell, a tiger cell, a bear cell, or a buffalo cell), a bird cell (e.g., a duck cell or a goose cell), or a whale cell. In one embodiment, the cell is a human cell, e.g., a human CNS cell.

APP expression is inhibited in the cell by at least about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or about 100%. In preferred embodiments, APP expression is inhibited by at least 20%.

The in vivo methods of the disclosure may include administering to a subject a composition containing a RNAi agent, where the RNAi agent includes a nucleotide sequence that is complementary to at least a part of an RNA transcript of the APP gene of the mammal to be treated. When the organism to be treated is a mammal such as a human, the composition can be administered by any means known in the art including, but not limited to oral, intraperitoneal, or parenteral routes, including intracranial (e.g., intraventricular, intraparenchymal and intrathecal), intravenous, intramuscular, intravitreal, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection.

In some embodiments, the administration is via a depot injection. A depot injection may release the RNAi agent in a consistent way over a prolonged time period. Thus, a depot injection may reduce the frequency of dosing needed to obtain a desired effect, e.g., a desired inhibition of APP, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the RNAi agent to the CNS.

The mode of administration may be chosen based upon whether local or systemic treatment is desired and based upon the area to be treated. The route and site of administration may be chosen to enhance targeting.

In one aspect, the present disclosure also provides methods for inhibiting the expression of an APP gene in a mammal. The methods include administering to the mammal a composition comprising a dsRNA that targets an APP gene in a cell of the mammal and maintaining the mammal for a time sufficient to obtain degradation of the mRNA transcript of the APP gene, thereby inhibiting expression of the APP gene in the cell. Reduction in gene expression can be assessed by any methods known it the art and by methods, e.g. qRT-PCR, described herein. Reduction in protein production can be assessed by any methods known it the art and by methods, e.g. ELISA, described herein. In one embodiment, a CNS biopsy sample or a cerebrospinal fluid (CSF) sample serves as the tissue material for monitoring the reduction in APP gene and/or protein expression (or of a proxy therefore, as described herein or as known in the art).

The present disclosure further provides methods of treatment of a subject in need thereof. The treatment methods of the disclosure include administering a RNAi agent of the disclosure to a subject, e.g., a subject that would benefit from a reduction and/or inhibition of APP expression, in a therapeutically effective amount of a RNAi agent targeting an APP gene or a pharmaceutical composition comprising a RNAi agent targeting an APP gene.

The present disclosure also provides methods of decreasing Aβ40 and/or Aβ42 levels in a subject. The methods include administering a RNAi agent of the disclosure to a subject, e.g., a subject that would benefit from a reduction and/or inhibition of APP expression, in a therapeutically effective amount of a RNAi agent targeting an APP gene or a pharmaceutical composition comprising a RNAi agent targeting an APP gene.

In addition, the present disclosure provides methods of preventing, treating and/or inhibiting the progression of an APP-associated disease or disorder (e.g., CAA and/or AD, optionally EOFAD) in a subject, such as the progression of an APP-associated disease or disorder to neurodegeneration, increased amyloid plaque formation and/or cognitive decline in a subject having an APP-associated disease or disorder or a subject at risk of developing an APP-associated disease or disorder. The methods include administering to the subject a therapeutically effective amount of any of the dsRNAs or the pharmaceutical composition provided herein, thereby preventing, treating and/or inhibiting the progression of an APP-associated disease or disorder in the subject.

A RNAi agent of the disclosure may be administered as a "free RNAi agent." A free RNAi agent is administered in the absence of a pharmaceutical composition. The naked RNAi agent may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the RNAi agent can be adjusted such that it is suitable for administering to a subject.

Alternatively, a RNAi agent of the disclosure may be administered as a pharmaceutical composition, such as a dsRNA liposomal formulation.

Subjects that would benefit from a reduction and/or inhibition of APP gene expression are those having an APP-associated disorder. The term "APP-associated disease" includes a disease, disorder or condition that would benefit from a decrease in APP gene expression, replication, or protein activity. Non-limiting examples of APP-associated diseases include, for example, CAA (including hCAA and sporadic CAA) and AD (including EOFAD, sporadic and/or late onset AD, optionally with CAA).

The disclosure further provides methods for the use of a RNAi agent or a pharmaceutical composition thereof, e.g., for treating a subject that would benefit from reduction and/or inhibition of APP expression, e.g., a subject having an APP-associated disorder, in combination with other pharmaceuticals and/or other therapeutic methods, e.g., with known pharmaceuticals and/or known therapeutic methods, such as, for example, those which are currently employed for treating these disorders. For example, in certain embodiments, a RNAi agent targeting APP is administered in combination with, e.g., an agent useful in treating an APP-associated disorder as described elsewhere herein or as otherwise known in the art. For example, additional agents suitable for treating a subject that would benefit from reduction in APP expression, e.g., a subject having an APP-associated disorder, may include agents currently used to treat symptoms of AD. Non-limiting examples of such agents may include cholinesterase inhibitors (such as donepezil, rivastigmate, and galantamine), memantine, BACEli, immunotherapies, and secretase inhibitors. The RNAi agent and additional therapeutic agents may be administered at the same time and/or in the same combination, e.g., intrathecally, or the additional therapeutic agent can be administered as part of a separate composition or at separate times and/or by another method known in the art or described herein.

In one embodiment, the method includes administering a composition featured herein such that expression of the target APP gene is decreased, such as for about 1, 2, 3, 4, 5, 6, 7, 8, 12, 16, 18, 24 hours, 28, 32, or about 36 hours. In one embodiment, expression of the target APP gene is decreased for an extended duration, e.g., at least about two, three, four days or more, e.g., about one week, two weeks, three weeks, or four weeks or longer.

Preferably, the RNAi agents useful for the methods and compositions featured herein specifically target RNAs (primary or processed) of the target APP gene. Compositions and methods for inhibiting the expression of these genes using RNAi agents can be prepared and performed as described herein.

Administration of the dsRNA according to the methods of the disclosure may result in a reduction of the severity, signs, symptoms, and/or markers of such diseases or disorders in a patient with an APP-associated disorder. By "reduction" in this context is meant a statistically significant decrease in such level. The reduction can be, for example, at least about 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of an APP-associated disorder may be assessed, for example, by periodic monitoring of a subject's cognition, CSF AP levels, etc. Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of a RNAi agent targeting APP or pharmaceutical composition thereof, "effective against" an APP-associated disorder indicates that administration in a clinically appropriate manner results in a beneficial effect for at least a statistically significant fraction of patients, such as an improvement of symptoms, a cure, a reduction in disease, extension of life, improvement in quality of life, or other effect generally recognized as positive by medical doctors familiar with treating APP-associated disorders and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given RNAi agent drug or formulation of that drug can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale, as but one example mental ability tests for dementia. Any positive change resulting in e.g., lessening of severity of disease measured using the appropriate scale, represents adequate treatment using a RNAi agent or RNAi agent formulation as described herein.

Subjects can be administered a therapeutic amount of dsRNA, such as about 0.01 mg/kg to about 200 mg/kg.

The RNAi agent can be administered intrathecally, via intravitreal injection and/or by intravenous infusion over a period of time, on a regular basis. In certain embodiments, after an initial treatment regimen, the treatments can be administered on a less frequent basis. Administration of the RNAi agent can reduce APP levels, e.g., in a cell, tissue, blood, CSF sample or other compartment of the patient by at least about 5%, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 39, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or at least about 99% or more. In a preferred embodiment, administration of the RNAi agent can reduce APP levels, e.g., in a cell, tissue, blood, CSF sample or other compartment of the patient by at least 20%.

Before administration of a full dose of the RNAi agent, patients can be administered a smaller dose, such as a 5% infusion reaction, and monitored for adverse effects, such as an allergic reaction. In another example, the patient can be monitored for unwanted immunostimulatory effects, such as increased cytokine (e.g., TNF-alpha or INF-alpha) levels.

Alternatively, the RNAi agent can be administered subcutaneously, i.e., by subcutaneous injection. One or more injections may be used to deliver the desired, e.g., monthly dose of RNAi agent to a subject. The injections may be repeated over a period of time. The administration may be repeated on a regular basis. In certain embodiments, after an initial treatment regimen, the treatments can be administered on a less frequent basis. A repeat-dose regimen may include administration of a therapeutic amount of RNAi agent on a regular basis, such as monthly or extending to once a year or once every 2, 3, 4 and/or 5 years. In certain embodiments, the RNAi agent is administered about once per month to about once per quarter (i.e., about once every three months).

Unless otherwise defined, all technical and scientific terms used herein have the same meaning as commonly understood by one of ordinary skill in the art to which this invention belongs. Although methods and materials similar or equivalent to those described herein can be used in the practice or testing of the RNAi agents and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1. RNAi Agent Design, Synthesis, Selection, and In Vitro Evaluation

This Example describes methods for the design, synthesis, selection, and in vitro evaluation of APP RNAi agents.
Source of Reagents
Where the source of a reagent is not specifically given herein, such reagent can be obtained from any supplier of reagents for molecular biology at a quality/purity standard for application in molecular biology.
Bioinformatics
A set of siRNA agents targeting the human amyloid beta precursor protein gene (APP; human NCBI refseq NM_201414; NCBI GeneID: 351; SEQ ID NO: 1), as well as the toxicology-species APP ortholog from *Macaca fascicularis* (cynomolgus monkey: XM_005548883.2; SEQ ID NO: 12) was designed using custom R and Python scripts. All the siRNA designs have a perfect match to the human APP transcript and a subset either perfect or near-perfect matches to the cynomolgus ortholog. The human NM_201414 REFSEQ mRNA, version 2, has a length of 3423 bases. The rationale and method for the set of siRNA designs is as follows: the predicted efficacy for every potential 23mer siRNA from position 10 through the end was determined with a random forest model derived from the direct measure of mRNA knockdown from several thousand distinct siRNA designs targeting a diverse set of vertebrate genes. For each strand of the siRNA, a custom Python script was used in a brute force search to measure the number and positions of mismatches between the siRNA and all potential alignments in the human transcriptome. Extra weight was given to mismatches in the seed region, defined here as positions 2-9 of the antisense oligonucleotide, as well the cleavage site of the siRNA, defined here as positions 10-11 of the antisense oligonucleotide. The relative weight of the mismatches was 2.8, 1.2, 1 for seed mismatches, cleavage site, and other positions up through antisense position 19. Mismatches in the first position were ignored. A specificity score was calculated for each strand by summing the value of each weighted mismatch. Preference was given to siRNAs whose antisense score in human and monkey was ≥3 with a predicted efficacy of ≥50% knockdown (161 sequences), or with an antisense score ≥2 and ≥60% predicted knockdown (118 sequences).

A second set of siRNAs targeting the toxicology-species *Mus musculus* (mouse) amyloid beta precursor protein (App, an ortholog of the human APP; mouse NCBI refseq NM_001198823; NCBI GeneID: 11820; SEQ ID NO: 13) as well as the *Rattus norvegicus* (rat) App ortholog: NM_019288.2 (SEQ ID NO: 14) was designed using custom R and Python scripts. All the siRNA designs possessed a perfect match to the mouse App transcript and a subset possessed either perfect or near-perfect matches to the rat ortholog. The mouse NM_001198823 REFSEQ mRNA, version 1, has a length of 3377 bases. The same selection process was used as stated above for human sequences, but with the following selection criteria applied: Preference was given to siRNAs whose antisense score in mouse and rat was ≥2.8 with a predicted efficacy of ≥50% knockdown (85 sequences), or with an antisense score ≥2 and ≥61% predicted knockdown (8 sequences).

Synthesis of APP Sequences

Synthesis of APP Single Strands and Duplexes

All oligonucleotides were prepared on a MerMade 192 synthesizer on a 1 μmole scale using universal or custom supports. All phosphoramidites were used at a concentration 100 mM in 100% Acetonitrile or 9:1 Acetonitrile:DMF with a standard protocol for 2-cyanoethyl phosphoramidites, except that the coupling time was extended to 400 seconds. Oxidation of the newly formed linkages was achieved using a solution of 50 mM $I_2$ in 9:1 Acetonitrile:Water to create phosphate linkages and 100 mM DDTT in 9:1 Pyridine:Acetonitrile to create phosphorothioate linkages. After the trityl-off synthesis, columns were incubated with 150 μL of 40% aqueous Methylamine for 45 minutes and the solution drained via vacuum into a 96-well plate. After repeating the incubation and draining with a fresh portion of aqueous Methylamine, the plate containing crude oligonucleotide solution was sealed and shaken at room temperature for an additional 60 minutes to completely remove all protecting groups. Precipitation of the crude oligonucleotides was accomplished via the addition of 1.2 mL of 9:1 Acetonitrile:EtOH to each well followed by incubation at −20° C. overnight. The plate was then centrifuged at 3000 RPM for 45 minutes, the supernatant removed from each well, and the pellets resuspended in 950 μL of 20 mM aqueous NaOAc. Each crude solution was finally desalted over a GE Hi-Trap Desalting Column (Sephadex G25 Superfine) using water to elute the final oligonucleotide products. All identities and purities were confirmed using ESI-MS and IEX HPLC, respectively.

Annealing of APP single strands was performed on a Tecan liquid handling robot. Sense and antisense single strands were combined in an equimolar ratio in 96 well plates and buffered with 10×PBS to provide a final duplex concentration of 10 μM in 1×PBS. After combining the complementary single strands, the 96 well plate was sealed tightly and heated in an oven at 100° C. for 40 minutes and allowed to come slowly to room temperature over a period of 2-3 hours and subsequently used directly for in vitro screening assays at the appropriate concentrations.

A detailed list of the modified APP sense and antisense strand sequences is shown in Tables 2A, 2B, 3, 5A, 5B, 6, 9, 10-15, 16A, 16B, and 26 and a detailed list of the unmodified APP sense and antisense strand sequences is shown in Tables 3, 6, 11, 13, 15, and 26.

In Vitro Primary Mouse, Primary Cynomolgus Hepatocytes, be(2)C and Neuron2A Screening:

Cell Culture and Transfections:

Human Be(2)C (ATCC), mouse Neuro2A (ATCC), Primary Mouse Hepatocytes (BioreclamationIVT) and Primary cyno hepatocytes (BioreclamationIVT) were transfected by adding 4.9 μl of Opti-MEM plus 0.1 μl of RNAiMAX per well (Invitrogen, Carlsbad Calif. cat #13778-150) to 5 μl of siRNA duplexes per well, with 4 replicates of each siRNA duplex, into a 384-well plate, and incubated at room temperature for 15 minutes. 40 μl of media containing ~5×10³ cells were then added to the siRNA mixture. Cells were incubated for 24 hours prior to RNA purification. Multi-dose experiments were performed at 10 nM and 0.1 nM.

Total RNA Isolation Using DYNABEADS mRNA Isolation Kit (Invitrogen, Part #: 610-12):

RNA was isolated using an automated protocol on a BioTek-EL406 platform using DYNABEADs (Invitrogen, cat #61012). Briefly, 70 μl of Lysis/Binding Buffer and 10 μl of lysis buffer containing 3 μl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 μl Wash Buffer A and once with Wash Buffer B. Beads were then washed with 150 μl Elution Buffer, re-captured and supernatant removed.

cDNA Synthesis Using ABI High Capacity cDNA Reverse Transcription Kit (Applied Biosystems, Foster City, Calif., Cat #4368813):

10 μl of a master mix containing 1 μl 10× Buffer, 0.4 μl 25× dNTPs, 1 μl 10× Random primers, 0.5 μl Reverse Transcriptase, 0.5 μl RNase inhibitor and 6.6 μl of $H_2O$ per reaction was added to RNA isolated above. Plates were sealed, mixed, and incubated on an electromagnetic shaker for 10 minutes at room temperature, followed by 2 h 37° C.

Real Time PCR:

Two μl of cDNA were added to a master mix containing 0.5 μl of human GAPDH TaqMan Probe (4326317E), and 0.5 μl APP human probe (Hs00169098_m1) and 5 μl Lightcycler 480 probe master mix (Roche Cat #04887301001) per well in a 384 well plates (Roche cat #04887301001). Or 2 μl of cDNA were added to a master mix containing 0.5 μl of mouse GAPDH TaqMan Probe (4352339E), and 0.5 μl APP mouse probe (Mm01344172_m1) and 5 μl Lightcycler 480 probe master mix (Roche Cat #04887301001) per well in a 384 well plates (Roche cat #04887301001). Or 2 μl of cDNA were added to a master mix containing 0.5 μl of Cyno GAPDH TaqMan Probe (forward primer: 5'-GCATCCTGGGCTACACTGA-3', reverse primer: 5'-TGGGTGTCGCTGTTGAAGTC-3', probe: 5'HEX-CCAGGTGGTCTCCTCC-3'BHQ-1) and 0.5 μl APP cynomolgus probe (Mf01552291_m1) and 5 μl Lightcycler 480 probe master mix (Roche Cat #04887301001) per well in a 384 well plates (Roche cat #04887301001). Real time PCR was done in a LightCycler480 Real Time PCR system (Roche). Each duplex was tested at least two times and data were normalized to cells transfected with a non-targeting control siRNA.

To calculate relative fold change, real time data were analyzed using the ΔΔCt method and normalized to assays performed with cells transfected with a non-targeting control siRNA. The results from the assays are shown in Tables 4 and 7.

TABLE 1

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| A | Adenosine-3'-phosphate |
| Agn | (S)-glycol-adenosine |
| Ahd | 2'-O-hexadecyl adenosine-3'-phosphate |

TABLE 1-continued

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cgn | (S)-glycol-cytidine |
| Chd | 2'-O-hexadecyl cytidine-3'-phosphate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Ggn | (S)-glycol-guanosine |
| Ghd | 2'-O-hexadecyl guanosine-3'-phosphate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tgn | (S)-glycol-5'-methyluridine |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uhd | 2'-O-hexadecyl uridine-3'-phosphate |
| Uf | 2'-fluorouridine-3'-phosphate |
| Ufs | 2'-fluorouridine -3'-phosphorothioate |
| Us | uridine -3'-phosphorothioate |
| N | any nucleotide (G, A, C, T or U) |
| a | 2'-O-methyladenosine-3'-phosphate |
| as | 2'-O-methyladenosine-3'- phosphorothioate |
| c | 2'-O-methylcytidine-3'-phosphate |
| cs | 2'-O-methylcytidine-3'- phosphorothioate |
| g | 2'-O-methylguanosine-3'-phosphate |
| gs | 2'-O-methylguanosine-3'- phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol Hyp-(GalNAc-alkyl)3 |
| dT | 2'-deoxythymidine-3'-phosphate |
| dC | 2'-deoxycytidine-3'-phosphate |
| P | Phosphate |
| VP | Vinyl-phosphonate |

TABLE 2A

Human APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392699 | gsasccc(Ahd)AfuUfAfAf guccuacuuuL96 | 33 | asAfsagua(Ggn)gacuuaAfu Ufgggucsasc | 34 | GUGACCCAAUUAAGUCCUACUUU | 35 |
| AD-392700 | uscsucc(Uhd)GfaUfUfAf uuuaucacauL96 | 36 | asUfsguga(Tgn)aaauaaUfc Afggagasgsa | 37 | UCUCUCCUGAUUAUUUAUCACAU | 38 |
| AD-392703 | cscsuga(Ahd)CfuUfGfAf auuaauccauL96 | 39 | asUfsggau(Tgn)aauucaAfg Ufucaggscsa | 40 | UGCCUGAACUUGAAUUAAUCCAC | 41 |
| AD-392704 | gsgsuuc(Ahd)AfaCfAfAf aggugcaauuL96 | 42 | asAfsuugc(Agn)ccuuugUfu Ufgaaccscsa | 43 | UGGGUUCAAACAAAGGUGCAAUC | 44 |
| AD-392705 | ususuac(Uhd)CfaUfUfAf ucgccuuugL96 | 45 | csAfsaaag(Ggn)cgauaaUfg Afguaaasusc | 46 | GAUUUACUCAUUAUCGCCUUUUG | 47 |
| AD-392707 | asusuua(Ghd)CfuGfUfAf ucaaacuaguL96 | 48 | asCfsuagu(Tgn)ugauacAfg Cfuaaaususc | 49 | GAAUUUAGCUGUAUCAAACUAGU | 50 |
| AD-392708 | asgsuau(Uhd)CfcUfUfUf ccugaucacuL96 | 51 | asGfsugau(Cgn)aggaaaGfu Afauacususa | 52 | UAAGUAUUCCUUUCCUGAUCACU | 53 |
| AD-392709 | gscsuua(Uhd)GfaCfAfUf gaucgcuuucL96 | 54 | gsAfsaagc(Ggn)aucaugUfc Afuaagcsasa | 55 | UUGCUUAUGACAUGAUCGCUUUC | 56 |
| AD-392710 | asasgau(Ghd)UfgUfCfUf ucaauuuguaL96 | 57 | usAfscaaa(Tgn)ugaagaCfa Cfaucuusasa | 58 | UUAAGAUGUGUCUUCAAUUUGUA | 59 |
| AD-392711 | gscsaaa(Ahd)CfcAfUfUf gcuucacuauL96 | 60 | asufsagug(Agn)agcaauGfg Ufuuugcsusg | 61 | CAGCAAAACCAUUGCUUCACUAC | 62 |
| AD-392712 | asusuua(Chd)UfcAfUfUf aucgccuuuL96 | 63 | asAfsaagg(Cgn)gauaauGfa Gfuaaauscsa | 64 | UGAUUUACUCAUUAUCGCCUUUU | 65 |
| AD-392713 | usascuc(Ahd)UfuAfUfCf gccuuugauL96 | 66 | asUfscaaa(Agn)ggcgauAfa Ufgaguasasa | 67 | uuuACUCAUUAUCGCCUUUUGAC | 68 |
| AD-392714 | usgsccu(Ghd)AfaCfUfUf guauuaaucuL96 | 69 | asGfsauua(Agn)uucaagUfu Cfaggcasusc | 70 | GAUGCCUGAACUUGAAUUAAUCC | 71 |

TABLE 2A-continued

Human APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392715 | csusgaa(Chd)UfuGfAfAf uuaauccacaL96 | 72 | usGfsugga(Tgn)uaauucAfa Gfuucagsgsc | 73 | GCCUGAACUUGAAUUAAUCCACA | 74 |
| AD-392716 | ususuag(Chd)UfgUfAfUf caaacuaguuL96 | 75 | asAfscuag(Tgn)uugauaCfa Gfcuaaasusu | 76 | AAUUUAGCUGUAUCAAACuAGuG | 77 |
| AD-392717 | gsasaua(Ghd)AfuUfCfUf cuccugauuaL96 | 78 | usAfsauca(Ggn)gagagaAfu Cfuauucsasu | 79 | AuGAAUAGAUUCUCUCCUGAUUA | 80 |
| AD-392718 | uscscug(Ahd)UfuUfAfUfUf uaucacauauL96 | 81 | asUfsaugu(Ngn)auaaauAfa Ufcaggasgsa | 82 | UCUCCUGAUUAUUUAUCACAUAG | 83 |
| AD-392719 | cscscaa(Uhd)UfaAfGfUf ccuacuuuauL96 | 84 | asUfsaaag(Tgn)aggacuUfa Afuugggsusc | 85 | GACCCAAUUAAGUCCUACUUUAC | 86 |
| AD-392720 | csasuau(Ghd)CfuUfUfAf agaaucgauuL96 | 87 | asAfsucga(Tgn)ucuuaaAfg Cfauaugsusa | 88 | UACAUAUGCUUUAAGAAUCGAUG | 89 |
| AD-392721 | csusucu(Chd)UfuGfCfCf uaaguauucuL96 | 90 | asGfsaaua(Cgn)uuaggcAfa Gfagaagscsa | 91 | UGCUUCUCUUGCCUAAGUAUUCC | 92 |
| AD-392722 | csasuug(Chd)UfuAfUfGf acaugaucguL96 | 93 | asCfsgauc(Agn)ugucauAfa Gfcaaugsasu | 94 | AUCAUUGCUUUAUGACAUGAUCGC | 95 |
| AD-392723 | csusuau(Ghd)AfcAfUfGf aucgcuuucuL96 | 96 | asGfsaaag(Cgn)gaucauGfu Cfauaagscsa | 97 | UGCUUAUGACAUGAUCGCUUUCU | 98 |
| AD-392724 | usasuga(Chd)AfuGfAfUf cgcuuucuauL96 | 99 | asufsagaa(Agn)gcgaucAfu Gfucauasasg | 100 | CuUAUGACAUGAUCGCUUUCUAC | 101 |
| AD-392725 | usgsaca(Uhd)GfaUfCfGfCf uuucuacauL96 | 102 | asUfsguag(Agn)aagcgaUfc Afugucasusa | 103 | UAUGACAUGAUCGCUUUCUACAC | 104 |
| AD-392726 | gsasucg(Chd)UfuUfCfUf acacuguauuL96 | 105 | asAfsuaca(Ggn)uguagaAfa Gfcgaucsasu | 106 | AUGAUCGCUUUCUACACUGUAUU | 107 |
| AD-392727 | asasaac(Uhd)AfuUfCfAf gaugacgucuL96 | 108 | asGfsacgu(Cgn)aucugaAfu Afguuuusgsc | 109 | GCAAAACUAUUCAGAUGACGUCU | 110 |
| AD-392728 | asasacu(Ahd)UfuCfAfGf augacgucuuL96 | 111 | asAfsgacg(Tgn)caucugAfa Ufaguuususg | 112 | CAAAACUAUUCAGAUGACGUCUU | 113 |
| AD-392729 | ascsgaa(Ahd)AfuCfCfAfAf cacuacaaguL96 | 114 | asCfsuugu(Agn)gguuggAfu Ufuucgusasg | 115 | CUACGAAAAUCCAACCUACAAGU | 116 |
| AD-392730 | usgscuu(Chd)UfcUfUfGf ccuaaguauuL96 | 117 | asAfsuacu(Tgn)aggcaaGfa Gfaagcasgsc | 118 | GCUGCUUCUCUUGCCUAAGUAUU | 119 |
| AD-392731 | usgscuu(Ahd)UfgAfCfAfUf ugaucgcuuuL96 | 120 | asAfsagcg(Agn)ucauguCfa Ufaagcasasu | 121 | AUUGCUUAUGACAUGAUCGCUUU | 122 |
| AD-392732 | usgsauc(Ghd)CfuUfUfCf uacacuguauL96 | 123 | asUfsacag(Tgn)guagaaAfg Cfgaucasusg | 124 | CAUGAUCGCUUUCUACACUGUAU | 125 |
| AD-392733 | asuscgc(Uhd)UfuCfUfAf cacuguauuaL96 | 126 | usAfsauac(Agn)guguagAfa Afgcgauscsa | 127 | UGAUCGCUUUCUACACUGUAUUA | 128 |
| AD-392734 | uscsuuu(Ghd)AfcCfGfAf aacgaaaacuL96 | 129 | asGfsuuuu(Cgn)gimucgGfu Cfaaagasusg | 130 | CAUCUUUGACCGAAACGAAACC | 131 |
| AD-392735 | gsusucu(Ghd)GfgUfUfGf acaaauaucaL96 | 132 | usGfsauau(Tgn)ugucaaCfc Cfagaacscsu | 133 | AGGUUCUGGGUUGACAAAUAUCA | 134 |
| AD-392736 | usgsggu(Uhd)GfaCfAfAf auaucaagauL96 | 135 | asUfscuug(Agn)uauuugUfc Afacccasgsa | 136 | UCUGGGUUGACAAAUAUCAAGAC | 137 |
| AD-392737 | gsasuuu(Ahd)CfuCfAfUf uaucgccuuuL96 | 138 | asAfsaggc(Ggn)auaaugAfg Ufaaaucsasu | 139 | AUGAUUUACUCAUUAUCGCCUUU | 140 |
| AD-392738 | uscscuu(Uhd)CfcUfGfAf ucacuaugcaL96 | 141 | usGfscaua(Ggn)ugaucaGfu Afaaggasasu | 142 | AUUCCUUUCCUGAUCACUAUGCA | 143 |
| AD-392739 | csusuuc(Chd)UfgAfUfCf acuaugcauuL96 | 144 | asAfsugca(Tgn)agugauCfa Gfgaaagsgsa | 145 | UCCUUUCCUGAUCACUAUGCAUU | 146 |

TABLE 2A-continued

Human APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392740 | asusugc(Uhd)UfaUfGfAf caugaucgcuL96 | 147 | asGfscgau(Cgn)augucaUfa Afgcaausgsa | 148 | UCAUUGCUUAUGACAUGAUCGCU | 149 |
| AD-392741 | uscsuuu(Ahd)AfcCfAfGf ucugaaguuuL96 | 150 | asAfsacuu(Cgn)agacugGfu Ufaaagasasa | 151 | UUUCUUUAACCAGUCUGAAGUUU | 152 |
| AD-392742 | gsgsauc(Ahd)GfuUfAfCf ggaaacgauuL96 | 153 | asAfsucgu(Tgn)uccguaAfc Ufgauccsusu | 154 | AAGGAUCAGUUACGGAAACGAUG | 155 |
| AD-392743 | csusggg(Uhd)UfgAfCfAf aauaucaagaL96 | 156 | usCfsuuga(Tgn)auuuguCfa Afcccagsasa | 157 | UUCUGGGUUGACAAAUAUCAAGA | 158 |
| AD-392744 | asusgau(Uhd)UfaCfUfCf auuaucgccuL96 | 159 | asGfsgcga(Tgn)aaugagUfa Afaucausasa | 160 | UUAUGAUUUACUCAUUAUCGCCU | 161 |
| AD-392745 | csusugu(Ghd)GfuUfUfGf ugacccaauuL96 | 162 | asAfsuugg(Ggn)ucacaaAfc Cfacaagsasa | 163 | UUCUUGUGGUUUGUGACCCAAUU | 164 |
| AD-392746 | asusaug(Chd)UfuUfAfAf gaaucgauguL96 | 165 | asCfsaucg(Agn)uucuuaAfa Gfcauausgsu | 166 | ACAUAUGCUUUAAGAAUCGAuGG | 167 |
| AD-392747 | ususugu(Chd)CfaCfGfUf aucuuugggu L96 | 168 | asCfsccaa(Agn)gauacgUfg Gfacaaasasa | 169 | UUUUUGUCCACGUAUCUUUGGGU | 170 |
| AD-392748 | uscsauu(Ghd)UfaAfGfCf acuuuuacguL96 | 171 | asCfsguaa(Agn)agugcuUfa Cfaaugasasc | 172 | GUUCAUUGUAAGCACUUUUACGG | 173 |
| AD-392749 | gsgscca(Ahd)CfaUfGfAf uuagugaacuL96 | 174 | asGfsuuca(Cgn)uaaucaUfg Ufuggccsasa | 175 | UUGGCCAACAUGAUUAGUGAACC | 176 |
| AD-392750 | gsasuca(Ghd)UfuAfCfGf gaaacgauguL96 | 177 | asCfsaucg(Tgn)uuccguAfa Cfugaucscsu | 178 | AGGAUCAGUUACGGAAACGAuGc | 179 |
| AD-392751 | usascgg(Ahd)AfaCfGfAf ugcucucauuL96 | 180 | asAfsugag(Agn)gcaucgUfu Ufccguasasc | 181 | GUUACGGAAACGAUGCUCUCAUG | 182 |
| AD-392752 | usgsauu(Uhd)AfcUfCfAf uuaucgccuuL96 | 183 | asAfsggcg(Agn)uaaugaGfu Afaaucasusa | 184 | UAUGAUUUACUCAUUAUCGCCUU | 185 |
| AD-392753 | gsusaga(Uhd)GfcCfUfGf aacuugaauuL96 | 186 | asAfsuuca(Agn)guucagGfc Afucuacsusu | 187 | AAGUAGAUGCCUGAACUUGAAUU | 188 |
| AD-392754 | ususgua(Uhd)AfuUfAfUf ucuugugguuL96 | 189 | asAfsccac(Agn)agaauaAfu Afuacaascsu | 190 | AGUUGUAUAUUAUUCUUGUGGUU | 191 |
| AD-392755 | asusugc(Uhd)GfcUfUfCf ugcuauauuuL96 | 192 | asAfsauau(Agn)gcagaaGfc Afgcaauscsu | 193 | AGAUUGCUGCUUCUGCUAUAUUU | 194 |
| AD-392756 | usgscua(Uhd)AfuUfUfGf ugauauaggaL96 | 195 | usCfscuau(Agn)ucacaaAfu Afuagcasgsa | 196 | UCUGCUAUAUUUGUGAUAUAGGA | 197 |
| AD-392757 | ascsaca(Uhd)UfaGfGfCf auugagacuuL96 | 198 | asAfsgucu(Cgn)aaugccUfa Afugugusgsc | 199 | GCACACAUUAGGCAUUGAGACUU | 200 |
| AD-392758 | asasgaa(Uhd)CfcCfUfGf uucauuguaaL96 | 201 | usUfsacaa(Tgn)gaacagGfg Afuucuususu | 202 | AAAAGAAUCCCUGUUCAUUGUAA | 203 |
| AD-392759 | csasuug(Uhd)AfaGfCfAf cuuuuacgguL96 | 204 | asCfscgua(Agn)aagugcUfu Afcaaugsasa | 205 | UUCAUUGUAAGCACUUUUACGGG | 206 |
| AD-392760 | ususgcu(Uhd)AfuGfAfCf augaucgcuuL96 | 207 | asAfsgcga(Tgn)caugucAfu Afagcaasusg | 208 | CAUUGCUUAUGACAUGAUCGCUU | 209 |
| AD-392761 | csasagg(Ahd)UfcAfGfUf uacggaaacuL96 | 210 | asGfsuuuc(Cgn)guaacuGfa Ufccuugsgsu | 211 | ACCAAGGAUCAGUUACGGAAACG | 212 |
| AD-392762 | asgsuuu(Chd)UfgGfGfUf ugacaaauauL96 | 213 | asUfsauuu(Ggn)ucaaccCfa Gfaaccusgsg | 214 | CCAGGUUCUGGGUUGACAAAUAU | 215 |
| AD-392763 | asasgau(Ghd)UfgGfGfUf ucaaacaaauL96 | 216 | asUfsuugu(Tgn)ugaaccCfa Cfaucuuscsu | 217 | AGAAGAUGUGGGUUCAAACAAAG | 218 |
| AD-392764 | csusgaa(Ghd)AfaGfAfAf acaguacacaL96 | 219 | usGfsugua(Cgn)uguuucUfu Cfuucagscsa | 220 | UGCUGAAGAAGAAACAGUACACA | 221 |

TABLE 2A-continued

Human APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392765 | asasguu(Ghd)GfaCfAfGf caaaaccauuL96 | 222 | asAfsuggu(Tgn)uugcugUfc Cfaacuuscsa | 223 | UGAAGUUGGACAGCAAAACCAUU | 224 |
| AD-392766 | asuscgg(Uhd)GfuCfCfAf uuuauagaauL96 | 225 | asUfsucua(Tgn)aaauggAfc Afccgausgsg | 226 | CCAUCGGUGUCCAUUUAUAGAAU | 227 |
| AD-392767 | uscsggu(Ghd)UfcCfAfUf uuauagaauaL96 | 228 | usAfsuucu(Agn)uaaaugGfa Cfaccgasusg | 229 | CAUCGGUGUCCAUUUAUAGAAUA | 230 |
| AD-392768 | gscsugu(Ahd)AfcAfCfAf aguagaugcuL96 | 231 | asGfscauc(Tgn)acuuguGfu Ufacagcsasc | 232 | GUGCUGUAACACAAGUAGAUGCC | 233 |
| AD-392769 | asasgua(Ghd)AfuGfCfCf ugaacuugaaL96 | 234 | usUfscaag(Tgn)ucaggcAfu Cfuacuusgsu | 235 | ACAAGUAGAUGCCUGAACUUGAA | 236 |
| AD-392770 | ususgug(Ghd)UfuUfGfUf gacccaauuaL96 | 237 | usAfsauug(Ggn)gucacaAfa Cfcacaasgsa | 238 | UCUUGUGGUUUGUGACCCAAUUA | 239 |
| AD-392771 | gsusuug(Uhd)GfaCfCfCf aauuaagucuL96 | 240 | asGfsacuu(Agn)auugggUfc Afcaaacscsa | 241 | UGGUUUGUGACCCAAUUAAGUCC | 242 |
| AD-392772 | gsusgac(Chd)CfaAfUfUf aaguccuacuL96 | 243 | asGfsuagg(Agn)cuuaauUfg Gfgucacsasa | 244 | UUGUGACCCAAUUAAGUCCUACU | 245 |
| AD-392773 | usasugc(Uhd)UfuAfAfGf aaucgaugguL96 | 246 | asCfscauc(Ggn)auucuuAfa Afgcauasusg | 247 | CAUAUGCUUUAAGAAUCGAUGGG | 248 |
| AD-392774 | ususugu(Ghd)AfuAfUfAf ggaauuaagaL96 | 249 | usCfsuuaa(Tgn)uccuauAfu Cfacaaasusa | 250 | UAUUUGUGAUAUAGGAAUUAAGA | 251 |
| AD-392775 | asasaga(Ahd)UfcCfCfUf guucauuguaL96 | 252 | usAfscaau(Ggn)aacaggGfa Ufucuuususc | 253 | GAAAAGAAUCCCUGUUCAUUGUA | 254 |
| AD-392776 | usgsauu(Ghd)UfaCfAfGf aaucauugcuL96 | 255 | asGfscaau(Ggn)auucugUfa Cfaaucasusc | 256 | GAUGAUUGUACAGAAUCAUUGCU | 257 |
| AD-392777 | usgsccu(Ghd)GfaCfAfAf acccuucuuuL96 | 258 | asAfsagaa(Ggn)gguuugUfc Cfaggcasusg | 259 | CAUGCCUGGACAAACCCUUCUUU | 260 |
| AD-392778 | gsasgca(Ahd)AfaCfUfAf uucagaugauL96 | 261 | asUfscauc(Tgn)gaauagUfu Ufugcucsusu | 262 | AAGAGCAAAACUAUUCAGAUGAC | 263 |
| AD-392779 | asgsuga(Ahd)CfcAfAfGf gaucaguuauL96 | 264 | asUfsaacu(Ggn)auccuuGfg Ufucacusasa | 265 | UUAGUGAACCAAGGAUCAGUUAC | 266 |
| AD-392780 | usgsaac(Chd)AfaGfGfAf ucaguuacguL96 | 267 | asCfsguaa(Cgn)ugauccUfu Gfguucascsu | 268 | AGUGAACCAAGGAUCAGUUACGG | 269 |
| AD-392781 | csasguu(Ahd)CfgGfAfAf acgaugcucuL96 | 270 | asGfsagca(Tgn)cguuucCfg Ufaacugsasu | 271 | AUCAGUUACGGAAACGAUGCUCU | 272 |
| AD-392782 | asgsaag(Ahd)UfgUfGfGf guucaaacaaL96 | 273 | usUfsguuu(Ggn)aacccaCfa Ufcuucusgsc | 274 | GCAGAAGAUGUGGGUUCAAACAA | 275 |
| AD-392783 | cscsucu(Ghd)AfaGfUfUf ggacagcaaaL96 | 276 | usUfsugcu(Ggn)uccaacUfu Cfagaggscsu | 277 | AGCCUCUGAAGUUGGACAGCAAA | 278 |
| AD-392784 | ususaug(Ahd)UfuUfAfCf ucauuaucguL96 | 279 | ascfsgaua(Agn)ugaguaAfa Ufcauaasasa | 280 | UUUUAUGAUUUACUCAUUAUCGC | 281 |
| AD-392785 | ascsagc(Uhd)GfuGfCfUf guaacacaauL96 | 282 | asUfsugug(Tgn)uacagcAfc Afgcuguscsa | 283 | UGACAGCUGUGCUGUAACACAAG | 284 |
| AD-392786 | usgsuga(Chd)CfcAfAfUf uaaguccuauL96 | 285 | asUfsagga(Cgn)uuaauuGfg Gfucacasasa | 286 | UUUGUGACCCAAUUAAGUCCUAC | 287 |
| AD-392787 | usascau(Ahd)UfgCfUfUf uaagaaucgaL96 | 288 | usCfsgauu(Cgn)uuaaagCfa Ufauguasasa | 289 | UUUACAUAUGCUUUAAGAAUCGA | 290 |
| AD-392788 | gsusaaa(Uhd)AfaAfUfAf cauucuuggaL96 | 291 | usCfscaag(Agn)auguauUfu Afuuuacsasu | 292 | AUGUAAAUAAAUACAUUCUUGGA | 293 |
| AD-392789 | uscsagu(Uhd)AfcGfGfAf aacgaugcuuL96 | 294 | asAfsgcau(Cgn)guuuccGfu Afacugasusc | 295 | GAUCAGUUAGGGAAACGAUGCUC | 296 |

TABLE 2A-continued

Human APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392790 | csusucc(Chd)GfuGfAfAf uggagaguuuL96 | 297 | asAfsacuc(Tgn)ccauucAfc Gfggaagsgsa | 298 | UCCUUCCCGUGAAUGGAGAGUUC | 299 |
| AD-392791 | asgsuug(Ghd)AfcAfGfCf aaaaccauuuL96 | 300 | asAfsaugg(Tgn)uuugcuGfu Cfcaacususc | 301 | GAAGUUGGACAGCAAAACCAUUG | 302 |
| AD-392792 | cscscau(Chd)GfgUfGfUf ccauuuauauL96 | 303 | asUfsauaa(Agn)uggacaCfc Gfaugggsusa | 304 | UACCCAUCGGUGUCCAUUUAUAG | 305 |
| AD-392793 | usgscac(Ahd)CfaUfUfAf ggcauugagaL96 | 306 | usCfsucaa(Tgn)gccuaaUfg Ufgugcascsa | 307 | UGUGCACACAUUAGGCAUUGAGA | 308 |
| AD-392794 | cscsaac(Ahd)UfgAfUfUf agugaaccaaL96 | 309 | usufsgguu(Cgn)acuaauCfa Ufguuggscsc | 310 | GGCCAACAUGAUUAGUGAACCAA | 311 |
| AD-392795 | asusgau(Uhd)AfgUfGfAf accaaggauuL96 | 312 | asAfsuccu(Tgn)gguucaCfu Afaucausgsu | 313 | ACAUGAUUAGUGAACCAAGGAUC | 314 |
| AD-392796 | ususagu(Ghd)AfaCfCfAf aggaucaguuL96 | 315 | asAfscuga(Tgn)ccuggUfu Cfacuaasusc | 316 | GAUUAGUGAACCAAGGAUCAGUU | 317 |
| AD-392797 | asascca(Ahd)GfgAfUfCf aguuacggaaL96 | 318 | usUfsccgu(Agn)acugauCfc Ufugguuscsa | 319 | UGAACCAAGGAUCAGUUACGGAA | 320 |
| AD-392798 | gsusuac(Ghd)GfaAfAfCf gaugcucucaL96 | 321 | usGfsagag(Cgn)aucguuUfc Cfguaacsusg | 322 | CAGUUACGGAAACGAUGCUCUCA | 323 |
| AD-392799 | gsasugc(Ahd)GfaAfUfUf ccgacaugauL96 | 324 | asUfscaug(Tgn)cggaauUfc Ufgcaucscsa | 325 | uGGAUGCAGAAUUCCGACAUGAC | 326 |
| AD-392800 | ususgga(Chd)AfgCfAfAf aaccauugcuL96 | 327 | asGfscaau(Ggn)guuugCfu Gfuccaascsu | 328 | AGUUGGACAGCAAAACCAUUGCU | 329 |
| AD-392801 | asasacc(Ahd)UfuGfCfUf ucacuacccaL96 | 330 | usGfsggua(Ggn)ugaagcAfa Ufgguuususg | 331 | CAAAACCAUUGCUUCACUACCCA | 332 |
| AD-392802 | cscsauc(Ghd)GfuGfUfCf cauuuauagaL96 | 333 | usCfsuaua(Agn)auggacAfc Cfgauggsgsu | 334 | ACCCAUCGGUGUCCAUUUAUAGA | 335 |
| AD-392803 | ususauc(Ghd)CfcUfUfUf ugacagcuguL96 | 336 | asCfsagcu(Ggn)ucaaaaGfg Cfgauaasusg | 337 | CAUUAUCGCCUUUUGACAGCUGU | 338 |
| AD-392804 | asuscgc(Chd)UfuUfUfGf acagcuguguL96 | 339 | asCfsacag(Cgn)ugucaaAfa Gfgcgausasa | 340 | UUAUCGCCUUUUGACAGCUGUGC | 341 |
| AD-392805 | ascsaca(Ahd)GfuAfGfAf ugccugaacuL96 | 342 | asGfsuuca(Ggn)gcaucuAfc Ufugugususa | 343 | UAACACAAGUAGAUGCCUGAACU | 344 |
| AD-392806 | usgsugg(Uhd)UfuGfUfGf acccaauuaaL96 | 345 | usUfsaauu(Ggn)ggucacAfa Afccacasasg | 346 | CUUGUGGUUUGUGACCCAAUUAA | 347 |
| AD-392807 | gsgsgau(Ghd)CfuUfCfAf ugugaacguuL96 | 348 | asAfscguu(Cgn)acaugaAfg Cfaucccscsc | 349 | GGGGGAUGCUUCAUGUGAACGUG | 350 |
| AD-392808 | usgsugc(Ahd)CfaCfAfUf uaggcauugaL96 | 351 | usCfsaaug(Cgn)cuaaugUfg Ufgcacasusa | 352 | UAUGUGCACACAUUAGGCAUUGA | 353 |
| AD-392809 | asasaug(Ghd)AfaGfUfGf gcaauauaauL96 | 354 | asufsuaua(rgn)ugccacUfu Cfcauuususc | 355 | GAAAAUGGAAGUGGCAAUAUAAG | 356 |
| AD-392810 | asusgga(Ahd)GfuGfGfCf aauauaagguL96 | 357 | asCfscuua(Tgn)auugccAfc Ufuccaususu | 358 | AAAUGGAAGUGGCAAUAUAAGGG | 359 |
| AD-392811 | usgsccc(Ghd)AfgAfUfCf cuguuaaacuL96 | 360 | asGfsuuua(Agn)caggauCfu Cfgggcasasg | 361 | CUUGCCCGAGAUCCUGUUAAACU | 362 |
| AD-392812 | asusuag(Uhd)GfaAfCfCf aaggaucaguL96 | 363 | asCfsugau(Cgn)cuugguCfu Afcuaauscsa | 364 | UGAUUAGUGAACCAAGGAUCAGU | 365 |
| AD-392813 | gsasacc(Ahd)AfgGfAfUf caguuacggaL96 | 366 | usCfscgua(Agn)cugaucCfu Ufgguucsasc | 367 | GUGAACCAAGGAUCAGUUACGGA | 368 |
| AD-392814 | asasgga(Uhd)CfaGfUfUf acggaaacgaL96 | 369 | usCfsguuu(Cgn)cguaacUfg Afuccuusgsg | 370 | CCAAGGAUCAGUUACGGAAACGA | 371 |

TABLE 2A-continued

Human APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392815 | csasaca(Ahd)AfgAfAfAf acgaaguugaL96 | 372 | usCfsaacu(Tgn)cguuuuCfu Gfuguugsgsc | 373 | GCCAACACAGAAAACGAAGUUGA | 374 |
| AD-392816 | usgsggu(Uhd)CfaAfAfCf aaaggugcaaL96 | 375 | usUfsgcac(Cgn)uuuguuUfg Afacccascsa | 376 | UGUGGGUUCAAACAAAGGUGCAA | 377 |
| AD-392817 | csasgug(Ahd)UfcGfUfCf aucaccuuguL96 | 378 | asCfsaagg(Tgn)gaugacGfa Ufcacugsusc | 379 | GACAGUGAUCGUCAUCACCUUGG | 380 |
| AD-392818 | ascscca(Uhd)CfgGfUfGf uccauuuauaL96 | 381 | usAfsuaaa(Tgn)ggacacCfg Afugggusasg | 382 | CUACCCAUCGGUGUCCAUUUAUA | 383 |
| AD-392819 | uscsuug(Uhd)GfgUfUfUf gugacccaauL96 | 384 | asUfsuggg(Tgn)cacaaaCfc Afcaagasasu | 385 | AUUCUUGUGGGUUUGUGACCCAAU | 386 |
| AD-392820 | ususugu(Ghd)AfcCfCfAf auuaaguccuL96 | 387 | asGfsgacu(Tgn)aauuggGfu Cfacaaascsc | 388 | GGUUUGUGACCCAAUUAAGUCCU | 389 |
| AD-392821 | ususgug(Ahd)CfcCfAfAf uuaaguccuaL96 | 390 | usAfsggac(Tgn)uaauugGfg Ufcacaasasc | 391 | GUUUGUGACCCAAUUAAGUCCUA | 392 |
| AD-392822 | ususcag(Ahd)UfgAfCfGf ucuuggccaaL96 | 393 | usUfsggcc(Agn)agacguCfa Ufcugaasusa | 394 | UAUUCAGAUGACGUCUUGGCCAA | 395 |
| AD-392823 | asuscag(Uhd)UfaCfGfGf aaacgaugcuL96 | 396 | asGfscauc(Ggn)uuuccgUfa Afcugauscsc | 397 | GGAUCAGUUACGGAAACGAUGCU | 398 |
| AD-392824 | usgsgau(Ghd)CfaGfAfAf uuccgacauuL96 | 399 | asAfsuguc(Ggn)gaauucUfg Cfauccasusc | 400 | GAUGGAUGCAGAAUUCCGACAUG | 401 |
| AD-392825 | gsuscca(Ahd)GfaUfGfCf agcagaacguL96 | 402 | asCfsgtmc(Tgn)gcugcaUfc Ufuggacsasg | 403 | CUGUCCAAGAUGCAGCAGAACGG | 404 |
| AD-392826 | usascCc(Ahd)UfcGfGfUf guccauuuauL96 | 405 | asUfsaaau(Ggn)gacaccGfa Ufgggusasgsu | 406 | ACUACCCAUCGGUGUCCAUUUAU | 407 |
| AD-392827 | ususuug(Ahd)CfaGfCfUf gugcuguaauL96 | 408 | asGfsuaca(Ggn)cacagcUfg Ufcaaaasgsg | 409 | CCUUUUGACAGCUGUGCUGUAAC | 410 |
| AD-392828 | ususgac(Ahd)GfcUfGfUf gcuguaacauL96 | 411 | asUfsgtua(Cgn)agcacaGfc Ufgucaasasa | 412 | UUUUGACAGCUGUGCUGUAACAC | 413 |
| AD-392829 | asgscug(Uhd)GfcUfGfUf aacacaaguaL96 | 414 | usAfscuug(Tgn)guuacaGfc Afcagcusgsu | 415 | ACAGCUGUGCUGUAACACAAGUA | 416 |
| AD-392830 | gsusuuu(Ahd)UfgUfGfCf acacauuaguL96 | 417 | asCfsuaau(Ggn)ugugcaCfa Ufaaaacsasg | 418 | CUGUUUUAUGUGCACACAUUAGG | 419 |
| AD-392831 | ususcaa(Uhd)UfaCfCfAf agaauucucuL96 | 420 | asGfsagaa(Tgn)ucuuggUfa Afuugaasgsa | 421 | UCUUCAAUUACCAAGAAUUCUCC | 422 |
| AD-392832 | csascac(Ahd)UfcAfGfUf aauguauucuL96 | 423 | asGfsaaua(Cgn)auuacuGfa Ufgugugsgsa | 424 | UCCACACAUCAGUAAUGUAUUCU | 425 |
| AD-392833 | usgsguc(Uhd)CfuAfUfAf cuacauuauuL96 | 426 | asAfsuaau(Ggn)uaguauAfg Afgaccasasa | 427 | UUUGGUCUCUAUACUACAUUAUU | 428 |
| AD-392834 | ascsccg(Uhd)UfuUfAfUf gauuuacucaL96 | 429 | usGfsagua(Agn)aucauaAfa Afcgggususu | 430 | AAACCCGUUUUAUGAUUUACUCA | 431 |
| AD-392835 | usascga(Ahd)AfaUfCfCf aaccuacaauL96 | 432 | usUfsgugua(Ggn)guuggaUfu Ufucguasgsc | 433 | GCUACGAAAAUCCAACCUACAAG | 434 |
| AD-392836 | uscscac(Ahd)CfaUfCfAf guaauguauuL96 | 435 | asAfsuaca(Tgn)uacugaUfg Ufguggasusu | 436 | AAUCCACACAUCAGUAAUGUAUU | 437 |
| AD-392837 | csusggu(Chd)UfcCfAfAf uuaccaagaaL96 | 438 | usUfscuug(Ggn)uaauugAfa Gfaccagscsa | 439 | UGCUGGUCUUCAAUUACCAAGAA | 440 |
| AD-392838 | gscscau(Chd)UfuUfGfAf ccgaaacgaaL96 | 441 | usUfscguu(Tgn)cggucaAfa Gfauggcsasu | 442 | AUGCCAUCUUUGACCGAAACGAA | 443 |
| AD-392839 | cscsauc(Uhd)UfuGfAfCf cgaaacgaaaL96 | 444 | usUfsucgu(Tgn)ucggucAfa Afgauggscsa | 445 | UGCCAUCUUUGACCGAAACGAAA | 446 |

TABLE 2A-continued

Human APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392840 | csusacg(Ahd)AfaAfUfCf caaccuacaaL96 | 447 | usUfsguag(Ggn)uuggauUfu Ufcguagscsc | 448 | GGCUACGAAAAUCCAACCACAA | 449 |
| AD-392841 | asuscca(Chd)AfcAfUfCf aguaauguauL96 | 450 | asUfsacau(Tgn)acugauGfu Gfuggaususa | 451 | uAAUCCACACAUCAGUAAUGUAU | 452 |
| AD-392842 | csasugc(Chd)AfuCfUfUf ugaccgaaauL96 | 453 | asUfsuucg(Ggn)ucaaagAfu Gfgcaugsasg | 454 | CUCAUGCCAUCUUUGACCGAAAC | 455 |
| AD-392843 | gsgscua(Chd)GfaAfAfAf uccaaccuauL96 | 456 | asUfsaggu(Tgn)ggauuuUfc Gfuagccsgsu | 457 | ACGGCUACGAAAAUCCAACCUAC | 458 |
| AD-392844 | uscsaug(Chd)CfaUfCfUf uugaccgaaaL96 | 459 | usUfsucgg(Tgn)caaagaUfg Gfcaugasgsa | 460 | UCUCAUGCCAUCUUUGACCGAAA | 461 |
| AD-392845 | csasgua(Chd)AfcAfUfCf cauucaucauL96 | 462 | asUfsgaug(Agn)auggauGfu Gfuacugsusu | 463 | AACAGUACACAUCCAUUCAUCAU | 464 |
| AD-392846 | asasscgg(Chd)UfaCfGfAf aaauccaacuL96 | 465 | asGfsuugg(Agn)uuuucgUfa Gfccguuscsu | 466 | AGAACGGCUACGAAAAUCCAACC | 467 |
| AD-392847 | gsasagu(Uhd)UfcAfUfUf augauacaaL96 | 468 | usUfsguau(Cgn)auaaauGfa Afacuucsasg | 469 | CUGAAGUUUCAUUUAUGAUACAA | 470 |
| AD-392848 | asusgcc(Ahd)UfcUfUfUf gaccgaaacuL96 | 471 | asGfsuuuc(Ggn)gucaaaGfa Ufggcausgsa | 472 | UCAUGCCAUCUUUGACCGAAACG | 473 |
| AD-392849 | gsasacg(Ghd)CfuUfCfGf aaaauccaauL96 | 474 | asUfsugga(Tgn)uuucguAfg Cfcguucsusg | 475 | CAGAACGGCUACGAAAAUCCAAC | 476 |
| AD-392850 | uscsuuc(Ghd)UfgCfCfUf guuuuauguuL96 | 477 | asAfscaua(Agn)aacaggCfa Cfgaagasasa | 478 | UUUCUUCGUGCCUGUUUUAUGUG | 479 |
| AD-392851 | ususgcc(Chd)GfaGfAfUf ccuguuaaauL96 | 480 | asUfsuuaa(Cgn)aggaucUfc Gfggcaasgsa | 481 | UCUUGCCCGAGAUCCUGUUAAAC | 482 |
| AD-392852 | csusucg(Uhd)GfcCfUfGf uuuuauguguL96 | 483 | asCfsacau(Agn)aaacagGfc Afcgaagsasa | 484 | UUCUUCGUGCCUGUUUUAUGUGC | 485 |
| AD-392853 | gscsgcc(Ahd)UfgUfCfCf caaaguuuauL96 | 486 | asUfsaaac(Tgn)uugggaCfa Ufggcgcsusg | 487 | CAGCGCCAUGUCCCAAAGUUUAC | 488 |
| AD-392854 | gsuscau(Ahd)GfcGfAfCf agugaucguuL96 | 489 | asAfscgau(Cgn)acugucGfc Ufaugacsasa | 490 | UUGUCAUAGCGACAGUGAUCGUC | 491 |
| AD-392855 | gscsuac(Ghd)AfaAfAfUf ccaaccuacaL96 | 492 | usGfsuagg(Tgn)uggautfau Cfguagcscsg | 493 | CGGCUACGAAAAUCCAACCUACA | 494 |
| AD-392856 | asusagc(Ghd)AfcAfGfUf gaucgucauuL96 | 495 | asAfsugac(Ggn)aucacuGfu Cfgcuausgsa | 496 | UCAUAGCGACAGUGAUCGUCAUC | 497 |
| AD-392857 | csusugc(Chd)CfgAfGfAf uccuguuaaaL96 | 498 | usUfsuaac(Agn)ggaucuCfg Gfgcaagsasg | 499 | CUCUUGCCCGAGAUCCUGUUAAA | 500 |
| AD-392858 | csuscau(Ghd)CfcAfUfCf uuugaccgaaL96 | 501 | usUfscggu(Cgn)aaagauGfg Cfaugagsasg | 502 | CUCUCAUGCCAUCUUUGACCGAA | 503 |
| AD-392859 | ascsggc(Uhd)AfcGfAfAf aauccaaccuL96 | 504 | asGfsguug(Ggn)auuuucGfu Afgccgususc | 505 | GAACGGCUACGAAAAUCCAACCu | 506 |
| AD-392860 | csasuca(Ahd)AfaAfUfUf gguguucuuuL96 | 507 | asAfsagaa(Cgn)accaauUfu Ufugaugsasu | 508 | AUCAUCAAAAAUUGGUGUUCUUU | 509 |
| AD-392861 | asuscca(Ahd)CfcUfAfCf aguucuuugL96 | 510 | csAfsaaga(Agu)cuuguaGfg Ufuggaususu | 511 | AAAUCCAACCUACAAGUUCUUUG | 512 |
| AD-392862 | csgscuu(Uhd)CfuAfCfAf cuguauucaL96 | 513 | usGfsuaau(Agn)caguguAfg Afaagcgsasu | 514 | AUCGCUUUCUACACUGUAUUACA | 515 |
| AD-392863 | uscscaa(Chd)CfuAfCfAf aguucuuugaL96 | 516 | usCfsaaag(Agn)acuguaAfg Gfuuggasusu | 517 | AAUCCAACCUACAAGUUCUUUGA | 518 |
| AD-392864 | uscsucu(Chd)UfuUfAfCf auuuggucuL96 | 519 | asGfsacca(Agn)aauguaAfa Gfagagasusa | 520 | UAUCUCUCUUUACAUUUGGUCU | 521 |

TABLE 2A-continued

Human APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392865 | csuscuc(Uhd)UfuAfCfAf uuuuggucuuL96 | 522 | asAfsgacc(Agn)aaauguAfa Afgagagsasu | 523 | AUCUCUCUUUACAUUUUGGUCUC | 524 |
| AD-392866 | ususugu(Ghd)UfaCfUfGf uaaagaauuuL96 | 525 | asAfsauuc(Tgn)uuacagUfa Cfacaaasasc | 526 | GUUUUGUGUACUGUAAAGAAuuu | 527 |
| AD-392867 | gsusgua(Chd)UfgUfAfAf agaauuuaguL96 | 528 | asCfsuaaa(Tgn)ucuuuaCfa Gfuacacsasa | 529 | UUGUGUACUGUAAAGAAUUUAGC | 530 |
| AD-392868 | ascscca(Ahd)UfuAfAfGf uccuacuuuaL96 | 531 | usAfsaagu(Agn)ggacuuAfa Ufugggucsa | 532 | UGACCCAAUUAAGUCCUACUUUA | 533 |
| AD-392869 | uscscua(Chd)UfuUfAfCf auaugcuuuaL96 | 534 | usAfsaagc(Agn)uauguaAfa Gfuaggascsu | 535 | AGUCCUACUUUACAUAUGCUUUA | 536 |
| AD-392870 | cscsuac(Uhd)UfuAfCfAf uaugcuuuaaL96 | 537 | usUfsaaag(Cgn)auauguAfa Afguaggsasc | 538 | GUCCUACUUUACAUAUGCUUUAA | 539 |
| AD-392871 | ususcua(Chd)AfcUfGfUf auuacauaaaL96 | 540 | usUfsuaug(Tgn)aauacaGfu Gfuagaasasg | 541 | CUUUCUACACUGUAUUACAUAAA | 542 |
| AD-392872 | uscsuac(Ahd)CfuGfUfAf uuacauaaauL96 | 543 | asUfsuuau(Ggn)uaauacAfg Ufguagasasa | 544 | UUUCUACACUGUAUUACAUAAAU | 545 |
| AD-392873 | csusuuu(Ahd)AfgAfUfGf ugcuucaauL96 | 546 | asUfsugaa(Ggn)acacauCfu Ufaaaagsasa | 547 | UUCUUUUAAGAUGUGUCUUCAUU | 548 |
| AD-392874 | asusgug(Uhd)CfuUfCfAf auuuguauaaL96 | 549 | usUfsauac(Agn)aauugaAfg Afcacauscsu | 550 | AGAUGUGUCUUCAAUUUGUAUAA | 551 |
| AD-392875 | asuscaa(Ahd)AfaUfUfGf uguucuuugL96 | 552 | csAfsaaga(Agn)caccaaUfu Ufuugausgsa | 553 | UCAUCAAAAUUGGUGUUCUUUG | 554 |
| AD-392876 | asasauc(Chd)AfaCfCfUf acaaguucuuL96 | 555 | asAfsgaac(Tgn)uguaggUfu Gfgauuususc | 556 | GAAAAUCCAACCUACAAGUUCUU | 557 |
| AD-392877 | gsusacu(Ghd)UfaAfAfGf aauuuagcuuL96 | 558 | asAfsgcua(Agn)auucuuUfa Cfaguacsasc | 559 | GUGUACUGUAAAGAAUUUAGCUG | 560 |
| AD-392878 | csusccu(Ghd)AfuUfAfUf uuaucacauaL96 | 561 | usAfsugug(Agn)uaaauaAfu Cfaggagsasg | 562 | CUCUCCUGAUUAUUUAUCACAUA | 563 |
| AD-392879 | gscscag(Uhd)UfgUfAfUf auuauucuuuL96 | 564 | asAfsagaa(Tgn)aauauaCfa Afcuggcsusa | 565 | UAGCCAGUUGUAUAUUAUUCUUG | 566 |
| AD-392880 | asasuua(Ahd)GfuCfCfUf acuuuacauaL96 | 567 | usAfsugua(Agn)aguaggAfc Ufuaauusgsg | 568 | CCAAUUAAGUCCUACUUUACAUA | 569 |
| AD-392881 | csusugc(Chd)UfaAfGfUf auuccuuucuL96 | 570 | asGfsaaag(Ggn)aauacuUfa Gfgcaagsasg | 571 | CUCUUGCCUAAGUAUUCCUUUCC | 572 |
| AD-392882 | asusucc(Uhd)UfuCfCfUf gaucacuauuL96 | 573 | asAfsuagu(Agn)aucaggAfa Afggaausasc | 574 | GUAUUCCUUUCCUGAUCACUAUG | 575 |
| AD-392883 | ascsuau(Ghd)CfaUfUfUf uaaaguuaaaL96 | 576 | usUfsuaac(Tgn)uuaaaaUfg Cfauagusgsa | 577 | UCACUAUGCAUUUUAAAGUUAAA | 578 |
| AD-392884 | usgsuuc(Ahd)UfuGfUfAf agcacuuuuaL96 | 579 | usAfsaaag(Tgn)gcuuacAfa Ufgaacasgsg | 580 | CCUGUUCAUUGUAAGCACUUUUA | 581 |
| AD-392885 | asasuua(Chd)CfaAfGfAf auucuccaaaL96 | 582 | usUfsugga(Ggn)aauucuUfg Gfuaauusgsa | 583 | UCAAUUACCAAGAAUUCUCCAAA | 584 |
| AD-392886 | ususacc(Ahd)AfgAfAfUf ucuccaaaauL96 | 585 | asUfsuuug(Ggn)agaauuCfu Ufgguaasusu | 586 | AAUUACCAAGAAUUCUCCAAAAC | 587 |
| AD-392887 | uscsauu(Ghd)CfuUfAfUf gacaugaucuL96 | 588 | asGfsauca(Tgn)gucauaAfg Cfaaugasusu | 589 | AAUCAUUGCUUAUGACAUGAUCG | 590 |
| AD-392889 | ususuua(Ahd)GfaUfGfUf gucuucaauuL96 | 591 | asAfsuuga(Agn)gacacaUfc Ufuaaaasgsa | 592 | UCUUUUAAGAUGUGUCUUCAAUU | 593 |
| AD-392890 | asusccu(Ghd)UfuAfAfAf cuuccuacaaL96 | 594 | usUfsguag(Ggn)aaguuuAfa Cfaggauscsu | 595 | AGAUCCUGUUAAACUUCCUACAA | 596 |

TABLE 2A-continued

Human APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392891 | ascsuau(Uhd)CfaGfAfUf gacgucuuguL96 | 597 | asCfsaaga(Cgn)gucaucUfg Afauagususu | 598 | AAACUAUUCAGAUGACGUCUUGG | 599 |
| AD-392892 | gsusuca(Uhd)CfaUfCfAf aaaauugguuL96 | 600 | asAfsccaa(Tgn)uuuugaUfg Afugaacsusu | 601 | AAGUUCAUCAUCAAAAAUUGGUG | 602 |
| AD-392893 | usasucu(Chd)UfcUfUfUf acauuuugguL96 | 603 | asCfscaaa(Agn)uguaaaGfa Gfagauasgsa | 604 | UCUAUCUCUCUUUACAUUUUGGU | 605 |
| AD-392894 | asuscuc(Uhd)CfuUfUfAf cauuuugguuL96 | 606 | asAfsccaa(Agn)auguaaAfg Afgagausasg | 607 | CUAUCUCUCUUUACAUUUUGGUC | 608 |
| AD-392895 | usgsugu(Ahd)CfuGfUfAf aagaauuuauL96 | 609 | asUfsaaau(Tgn)cuuuacAfg Ufacacasasa | 610 | UUUGUGUACUGUAAAGAAUUUAG | 611 |
| AD-392896 | csusacu(Uhd)UfaCfAfUf augcuuuuauL96 | 612 | asUfsuaaa(Ggn)cauaugUfa Afaguagsgsa | 613 | UCCUACUUUACAUAUGCUUUAAG | 614 |
| AD-392897 | usgsccu(Ahd)AfgUfAfUu uccuuuccuuL96 | 615 | asAfsggaa(Agn)ggaauaCfu Ufaggcasasg | 616 | CUUGCCUAAGUAUUCCUUUCCUG | 617 |
| AD-392898 | asasgua(Uhd)UfcCfUfUf uccugaucauL96 | 618 | asUfsgauc(Agn)ggaaagGfa Afuacuusasg | 619 | CUAAGUAUUCCUUUCCUGAUCAC | 620 |
| AD-392899 | gsusauu(Chd)CfuUfUfCf cugaucacuaL96 | 621 | usAfsguga(Tgn)caggaaAfg Gfaauacsusu | 622 | AAGUAUUCCUUUCCUGAUCACUA | 623 |
| AD-392900 | ususccu(Ghd)AfuCfAfCf uauacauuuuL96 | 624 | asAfsaaug(Cgn)auagugAfu Cfaggaasasg | 625 | CUUUCCUGAUCACUAUGCAUUUU | 626 |
| AD-392901 | csusgau(Chd)AfcUfAfUf gcauuuuaaaL96 | 627 | usUfsuaaa(Agn)ugcauaGfu Gfaucagsgsa | 628 | UCCUGAUCACUAUGCAUUUUAAA | 629 |
| AD-392902 | csascgu(Ahd)UfcUfUfUf gggucuuugaL96 | 630 | usCfsaaag(Agn)cccaaaGfa Ufacgugsgsa | 631 | UCCACGUAUCUUUGGGUCUUUGA | 632 |
| AD-392903 | usgsggu(Chd)UfuUfGfAf uaaagaaaauL96 | 633 | asUfsuuuc(Tgn)uuaucaAfa Gfacccasasa | 634 | UUUGGGUCUUUGAUAAAGAAAAG | 635 |
| AD-392904 | uscsaau(Uhd)AfcCfAfAf gaauucuccaL96 | 636 | usGfsgaga(Agn)uucuugGfu Afauugasasg | 637 | CUUCAAUUACCAAGAAUUCUCCA | 638 |
| AD-392906 | uscsgcu(Uhd)UfcUfAfCf acuguauuauL96 | 639 | asUfsaaua(Cgn)aguguaGfa Afagcgasusc | 640 | GAUCGCUUUCUACACUGUAUUAC | 641 |
| AD-392907 | asusuuu(Chd)UfuUfAfAf ccagcugaaL96 | 642 | usUfscaga(Cgn)ugguuaAfa Gfaaaausasg | 643 | CAAUUUUCUUUAACCAGUCUGAA | 644 |
| AD-392908 | csusuua(Ahd)CfcAfGfUf cugaaguuucL96 | 645 | gsAfsaacu(Tgn)cagacuGfg Ufuaaagsasa | 646 | UUCUUUAACCAGUCUGAAGUUUC | 647 |
| AD-392909 | usasaga(Uhd)GfuGfUfCf uucaauuuguL96 | 648 | asCfsaaau(Tgn)gaagacAfc Afucuuasasa | 649 | UUUAAGAUGUGUCUUCAAUUUGU | 650 |
| AD-392910 | gsasucc(Uhd)GfuUfAfAf acuuccuacaL96 | 651 | usGfsuagg(Agn)aguuuaAfc Afggaucsusc | 652 | GAGAUCCUGUUAAACUUCCUACA | 653 |
| AD-392911 | csusgcu(Uhd)CfaGfAfAf agagcaaaauL96 | 654 | asUfsuuug(Cgn)ucuuucUfg Afagcagscsu | 655 | AGCUGCUUCAGAAAGAGCAAAAC | 656 |
| AD-392912 | csasgaa(Ahd)GfaGfCfAf aaacuauucaL96 | 657 | usGfsaaua(Ggn)uuuugcUfc Ufuucugsasa | 658 | uUCAGAAAGAGCAAAACUAUUCA | 659 |
| AD-392913 | usasuga(Ahd)GfuUfCfAf ucaucaaaaL96 | 660 | usUfsuuug(Agn)ugaugaAfc Ufucauasusc | 661 | GAUAUGAAGUUCAUCAUCAAAAA | 662 |
| AD-392914 | csasuca(Uhd)CfaAfAfAf auuggguuuL96 | 663 | asAfsacac(Cgn)aauuuuUfg Afugausasa | 664 | UUCAUCAUCAAAAAUUGGUGUUC | 665 |
| AD-392915 | uscsaaa(Ahd)AfuUfGfGf uguucuuguL96 | 666 | asCfsaaag(Agn)acaccaAfu Ufuuugasusg | 667 | CAUCAAAAAUUGGUGUUCUUUGC | 668 |
| AD-392916 | asasaau(Chd)CfaAfCfCf uacaaguucuL96 | 669 | asGfsaacu(Tgn)guaggaUfg Gfauuuuscsg | 670 | CGAAAAUCCAACCUACAAGUUCU | 671 |

TABLE 2A-continued

Human APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392917 | cscsaac(Chd)UfaCfAfAf guucuuugauL96 | 672 | asUfscaaa(Ggn)aacuugUfa Gfguuggsasu | 673 | AUCCAACCUACAAGUUCUUUGAG | 674 |
| AD-392918 | ascsuca(Uhd)UfaUfCfGf ccuuuugacaL96 | 675 | usGfsucaa(Agn)aggcgaUfa Afugagususa | 676 | UUACUCAUUAUCGCCUUUUGACA | 677 |
| AD-392919 | csuscau(Uhd)AfuCfGfCf cuuuugacauL96 | 678 | asUfsguca(Agn)aaggcgAfu Afaugagsusa | 679 | UACUCAUUAUCGCCUUUUGACAG | 680 |
| AD-392920 | usgsugc(Uhd)GfuAfAfCf acaaguagauL96 | 681 | asUfscuac(Tgn)uguguuAfc Afgcacasgsc | 682 | GCUGUGCUGUAACACAAGUAGAU | 683 |
| AD-392921 | gsusgcu(Ghd)UfaAfCfAf caaguagauuL96 | 684 | asAfsucua(Cgn)uuguguUfa Cfagcacsasg | 685 | CUGUGCUGUAACACAAGUAGAUG | 686 |
| AD-392922 | uscsuuu(Ahd)CfaUfUfUf ggucucuauL96 | 687 | asUfsagag(Agn)ccaaaaUfg Ufaaagasgsa | 688 | UCUCUUUACAUUUUGGUCUCUAU | 689 |
| AD-392923 | asusggg(Uhd)UfuUfGfUf guacuguaaaL96 | 690 | usUfsuaca(Ggn)uacacaAfa Afcccaususa | 691 | UAAUGGGUUUUGUGUACUGUAAA | 692 |
| AD-392924 | ususgug(Uhd)AfcUfGfUf aaagaauuuaL96 | 693 | usAfsaauu(Cgn)uuuacaGfu Afcacaasasa | 694 | UUUUGUGUACUGUAAAGAAUUUA | 695 |
| AD-392925 | gscsugu(Ahd)UfcAfAfAf cuagugcauuL96 | 696 | asAfsugca(Cgn)uaguuuGfa Ufacagcsusa | 697 | UAGCUGUAUCAAACUAGUGCAUG | 698 |
| AD-392926 | csusagu(Ghd)CfaUfGfAf auagauucuuL96 | 699 | asAfsgaau(Cgn)uauucaUfg Cfacuagsusu | 700 | AACUAGUGCAUGAAUAGAUUCUC | 701 |
| AD-392927 | usasgug(Chd)AfuGfAfAf uagauucucuL96 | 702 | asGfsagaa(Tgn)cuauucAfu Gfcacuasgsu | 703 | ACUAGUGCAUGAAUAGAUUCUCU | 704 |
| AD-392928 | csuscuc(Chd)UfgAfUfUf auuuaucacaL96 | 705 | usGfsugau(Agn)aauaauCfa Gfgagagsasa | 706 | UUCUCUCCUGAUUAUUUAUCACA | 707 |
| AD-392929 | cscsuga(Uhd)UfaUfUfUf aucacauaguL96 | 708 | asCfsuaug(Tgn)gauaaaUfa Afucaggsasg | 709 | CUCCUGAUUAUUUAUCACAUAGC | 710 |
| AD-392930 | usasagu(Chd)CfuAfCfUf uuacauauguL96 | 711 | asCfsauau(Ggn)uaaaguAfg Gfacuuasasu | 712 | AUUAAGUCCUACUUUACAUAUGC | 713 |
| AD-392931 | asgsucc(Uhd)AfcUfUfUf acauaugcuuL96 | 714 | asAfsgcau(Agn)uguaaaGfu Afggacususa | 715 | UAAGUCCUACUUUACAUAUGCUU | 716 |
| AD-392932 | gsusccu(Ahd)CfuUfUfAf cauaugcuuuL96 | 717 | asAfsagca(Tgn)auguaaAfg Ufaggacsusu | 718 | AAGUCCUACUUUACAUAUGCUUU | 719 |
| AD-392933 | ususcuc(Uhd)UfgCfCfUf aaguauuccuL96 | 720 | asGfsgaau(Agn)cuuaggCfa Afgagaasgsc | 721 | GCUUCUCUUGCCUAAGUAUUCCU | 722 |
| AD-392934 | csuscuu(Ghd)CfcUfAfAf guauuccuuL96 | 723 | asAfsagga(Agn)uacuuaGfg Cfaagagsasa | 724 | UUCUCUUGCCUAAGUAUUCCUUU | 725 |
| AD-392935 | usasuuc(Chd)UfuUfCfCf ugaucacuauL96 | 726 | asUfsagug(Agn)ucaggaAfa Gfgaauascsu | 727 | AGUAUUCCUUUCCUGAUCACUAU | 728 |
| AD-392936 | ususucc(Uhd)GfaUfCfAf cuaugcauuuL96 | 729 | asAfsaugc(Agn)uagugaUfc Afggaaasgsg | 730 | CCUUUCCUGAUCACUAUGCAUUU | 731 |
| AD-392937 | csascua(Uhd)GfcAfUfUf uaaaguuaaL96 | 732 | usUfsaacu(Tgn)uaaaauGfc Afuagugsasu | 733 | AUCACUAUGCAUUUUAAAGUUAA | 734 |
| AD-392938 | csusgca(Uhd)UfuUfAfCf uguacagauuL96 | 735 | asAfsucug(Tgn)acaguaAfa Afugcagsusc | 736 | GACUGCAUUUUACUGUACAGAUU | 737 |
| AD-392939 | ususcug(Chd)UfaUfAfUf uugugauauaL96 | 738 | usAfsuauc(Agn)caaauaUfa Gfcagaasgsc | 739 | GCUUCUGCUAUAUUUGUGAUAUA | 740 |
| AD-392940 | uscsugc(Uhd)AfuAfUfUf ugugauauauL96 | 741 | asUfsauau(Cgn)acaaauAfu Afgcagasasg | 742 | CUUCUGCUAUAUUUGUGAUAUAG | 743 |
| AD-392941 | ascsgua(Uhd)CfuUfUfGf ggucuuugauL96 | 744 | asUfscaaa(Ggn)acccaaAfg Afuacgusgsg | 745 | CCACGUAUCUUUGGGUCUUUGAU | 746 |

TABLE 2A-continued

Human APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392942 | uscsuuu(Ghd)GfgUfCfUf uugauaaagaL96 | 747 | usCfsuuua(Tgn)caaagaCfc Cfaaagasusa | 748 | UAUCUUUGGGUCUUUGAUAAAGA | 749 |
| AD-392943 | csusuug(Ghd)GfuCfUfUf ugauaaagaaL96 | 750 | usUfscuuu(Agn)ucaaagAfc Cfcaaagsasu | 751 | AUCUUUGGGUCUUUGAUAAAGAA | 752 |
| AD-392944 | ususggg(Uhd)CfuUfUfGf auaaagaaaaL96 | 753 | usUfsuucu(Tgn)uaucaaAfg Afcccaasasg | 754 | CUUUGGGUCUUUGAUAAAGAAAA | 755 |
| AD-392945 | asgsaau(Chd)CfcUfGfUf ucauuguaauL96 | 756 | asUfsuaca(Agn)ugaacaGfg Gfauucsusu | 757 | AAAGAAUCCCUGUUCAUUGUAAG | 758 |
| AD-392946 | gsasauc(Chd)CfuGfUfUf cauuguaaguL96 | 759 | asCfsuuac(Agn)augaacAfg Gfgauucsusu | 760 | AAGAAUCCCUGUUCAUUGUAAGC | 761 |
| AD-392947 | gsusuca(Uhd)UfgUfUfAfAf gcacuuuuauL96 | 762 | asUfsaaaa(Ggn)ugcuuaCfa Afugaacsasg | 763 | CUGUUCAUUGUAAGCACUUUUAC | 764 |
| AD-392948 | ususaug(Ahd)CfaUfGfAf ucgcuuucuaL96 | 765 | usAfsgaaa(Ggn)cgaucaUfg acauaasgsc | 766 | GCUUAUGACAUGAUCGCUUUCUA | 767 |
| AD-392949 | asusgac(Ahd)UfgAfUfCf gcuuucuacaL96 | 768 | usGfsuaga(Agn)agcgauCfa Ufgucausasa | 769 | UUAUGACAUGAUCGCUUUCUACA | 770 |
| AD-392950 | csasuga(Uhd)CfgCfUfUf ucuacacuguL96 | 771 | asCfsagug(Tgn)agaaagCfg Afucaugsusc | 772 | GACAUGAUCGCUUUCUACACUGU | 773 |
| AD-392951 | csusuuc(Uhd)AfcAfCfUf guauuacauaL96 | 774 | usAfsugua(Agn)uacaguGfu Afgaaagscsg | 775 | CGCUUUCUACACUGUAUUACAUA | 776 |
| AD-392952 | gsasuuc(Ahd)AfuUfUfUf cuuuaaccauL96 | 777 | asUfsgguu(Agn)aagaaaAfu Ufgaaucsusg | 778 | CAGAUUCAAUUUUCUUUAACCAG | 779 |
| AD-392953 | ususucu(Uhd)UfaAfCfCf agucugaaguL96 | 780 | asCfsuuca(Ggn)acugguUfa Afagaaasasu | 781 | AUUUUCUUUAACCAGUCUGAAGU | 782 |
| AD-392954 | ususuaa(Ghd)AfuGfUfGf ucuucaauuuL96 | 783 | asAfsauug(Agn)agacacAfu Cfuuaaasasg | 784 | CUUUUAAGAUGUGUCUUCAAUUu | 785 |
| AD-392955 | ususaag(Ahd)UfgUfGfUf cuucaauuugL96 | 786 | csAfsaauu(Ggn)aagacaCfa Ufcuuaasasa | 787 | UUUUAAGAUGUGUCUUCAAUUUG | 788 |
| AD-392956 | asgsaug(Uhd)GfuCfUfUf caauuuguauL96 | 789 | asUfsacaa(Agn)uugaagAfc Afcaucsusa | 790 | UAAGAUGUGUCUUCAAUUUGUAU | 791 |
| AD-392957 | usgsucu(Uhd)CfaAfUfUf uguauaaauL96 | 792 | asUfsuuua(Tgn)acaaauUfg Afagacascsa | 793 | UGUGUCUUCAAUUUGUAUAAAAU | 794 |
| AD-392958 | csusuca(Ahd)UfuUfGfUf auaaaaugguL96 | 795 | asCfscauu(Tgn)uauacaAfa Ufugaagsasc | 796 | GUCUUCAAUUUGUAUAAAAUGGU | 797 |
| AD-392959 | asusggu(Ghd)UfuUTUfCf auguaaauaaL96 | 798 | usUfsauuu(Agn)caugaaAfa Cfaccaususu | 799 | AAAUGGUGUUUUCAUGUAAAUAA | 800 |
| AD-392960 | ususcuu(Uhd)UfaAfGfAf ugugucuucaL96 | 801 | usGfsaaga(Cgn)acacucUfa Afaagaasgsg | 802 | CCUUCUUUAAGAUGUGUCUUCA | 803 |
| AD-392961 | usgsuau(Uhd)CfuAfUfCf ucucuuuacaL96 | 804 | usGfsuaaa(Ggn)agagauAfg Afauacasusu | 805 | AAUGUAUUCUAUCUCUCUUUACA | 806 |
| AD-392962 | gsusuc(Uhd)AfuAfCfUf acauuauuaaL96 | 807 | usUfsaaua(Agn)uguaguAfu Afgagacscsa | 808 | UGGUCUCUAUACUACAUUAUUAA | 809 |
| AD-392963 | uscsucu(Ahd)UfaCfUfAf cauuauuaauL96 | 810 | asUfsuaau(Agn)auguagUfa Ufagagascsc | 811 | GGUCUCUAUACUACAUUAUUAAU | 812 |
| AD-392964 | csuscua(Uhd)AfcUfAfCf auuauuaauuL96 | 813 | asAfsuuaa(Tgn)aauguaGfu Afuagagsasc | 814 | GUCUCUAUACUACAUUAUUAAUG | 815 |
| AD-392965 | csusuca(Ahd)UfuAfCfCf aagaauucuuL96 | 816 | asAfsgaau(Tgn)cuugguAfa Ufugaagsasc | 817 | GUCUUCAAUUACCAAGAAUUCUC | 818 |
| AD-392966 | cscsaca(Chd)AfuCfAfGf uaauguauuuL96 | 819 | asAfsauac(Agn)uuacugAfu Gfuguggsasu | 820 | AUCCACACAUCAGUAAUGUAUUC | 821 |

TABLE 2A-continued

Human APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392967 | csusauc(Uhd)CfuCfUfUf uacauuuuguL96 | 822 | asCfsaaaa(Tgn)guaaagAfg Afgauagsasa | 823 | UUCUAUCUCUCUUUACAUUUUGG | 824 |
| AD-392968 | gsgsucu(Chd)UfaUfAfCf uacauuauuaL96 | 825 | usAfsauaa(Tgn)guaguaUfa Gfagaccsasa | 826 | UUGGUCUCUAUACUACAUUAUUA | 827 |
| AD-392969 | uscsuau(Ahd)CfuAfCfAf uuauuaauguL96 | 828 | asCfsauua(Agn)uaauguAfg Ufauagasgsa | 829 | UCUCUAUACUACAUUAuuAAUGG | 830 |
| AD-392970 | gsgsucu(Uhd)CfaAfUfUf accaagaauuL96 | 831 | asAfsuucu(Tgn)gguaauUfg Afagaccsasg | 832 | CUGGUCUUCAAUUACCAAGAAUU | 833 |
| AD-392971 | csasgga(Uhd)AfuGfAfAf guucaucauuL96 | 834 | asAfsugau(Ggn)aacuucAfu Afuccugsasa | 835 | CUCAGGAUAUGAAGUUCAUCAUC | 836 |
| AD-392972 | ascsaca(Uhd)CfaGfUfAf auguauucuaL96 | 837 | usAfsgaau(Agn)cauuacUfg Afugugusgsg | 838 | CCACACAUCAGUAAUGUAUUCUA | 839 |
| AD-392973 | csusaua(Chd)UfaCfAfUf uauuaaugguL96 | 840 | asCfscauu(Agn)auaaugUfa Gfuauagsasg | 841 | CUCUAUACUACAUUAUUAAUGGG | 842 |
| AD-392974 | cscscgu(Uhd)UfuAfUfGf auuuacucauL96 | 843 | asUfsgagu(Agn)aaucauAfa Afacgggsusu | 844 | AACCCGUUUUAUGAUUUACUCAU | 845 |
| AD-392975 | ususcca(Uhd)GfaCfUfGf cauuuuacuuL96 | 846 | asAfsguaa(Agn)augcagUfc Afuggaasasa | 847 | UUUUCCAUGACUGCAUUUUACUG | 848 |
| AD-392976 | uscsuuc(Ahd)AfuUfAfCf caagaauucuL96 | 849 | asGfsaauu(Cgn)uugguaAfu Ufgaagascsc | 850 | GGUCUUCAAUUACCAAGAAUUCU | 851 |
| AD-392977 | csusgaa(Ghd)UfuUfCfAf uuuaugauauL96 | 852 | asUfsauca(Tgn)aaaugaAfa Cfuucagsasc | 853 | GUCUGAAGUUUCAUUUAUGAUAC | 854 |

TABLE 2B

Human APP Modified Sequences, No "L96" Linker

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392699 | gsascccc(Ahd)AfuUfAfAf guccuacuuu | 33 | asAfsagua(Ggn)gacuuaAfu Ufgggucsasc | 34 | GUGACCCAAUUAAGUCCUACUUU | 35 |
| AD-392700 | uscsucc(Uhd)GfaUfUfAf uuuaucacau | 36 | asUfsguga(Tgn)aaauaaUfc Afggagasgsa | 37 | UCUCUCCUGAUUAUUUAUCACAU | 38 |
| AD-392703 | cscsuga(Ahd)CfuUfGfAf auuaauccau | 39 | asUfsggau(Tgn)aauucAfg Ufucaggscsa | 40 | UGCCUGAACUUGAAUUAAUCCAC | 41 |
| AD-392704 | gsgsuuc(Ahd)AfaCfAfAf aggugcaauu | 42 | asAfsuugc(Agn)ccuuugUfu Ufgaaccscsa | 43 | UGGGUUCAAACAAAGGUGCAAUC | 44 |
| AD-392705 | ususuac(Uhd)CfaUfUfAf ucgccuuuug | 45 | csAfsaaag(Ggn)cgauaaUfg Afguaaasusc | 46 | GAUUUACUCAUUAUCGCCUUUUG | 47 |
| AD-392707 | asusuua(Ghd)CfuGfUfAf ucaaacuagu | 48 | asCfsuagu(Tgn)ugauacAfg Cfuaaaususc | 49 | GAAUUUAGCUGUAUCAAACUAGU | 50 |
| AD-392708 | asgsuau(Uhd)CfcUfUfUf ccugaucacu | 51 | asGfsugau(Cgn)aggaaaGfg Afauacususa | 52 | UAAGUAUUCCUUUCCUGAUCACU | 53 |
| AD-392709 | gscsuua(Uhd)GfaCfAfUf gaucgcuuuc | 54 | gsAfsaagc(Ggn)aucaugUfc Afuaagcsasa | 55 | UUGCUUAUGACAUGAUCGCUUUC | 56 |
| AD-392710 | asasgau(Ghd)UfgUfCfUf ucaauuugua | 57 | usAfscaaa(Tgn)ugaagaCfa Cfaucuusasa | 58 | UUAAGAUGUGUCUUCAAUUUGUA | 59 |
| AD-392711 | gscsaaa(Ahd)CfcAfUfUf gcuucacuau | 60 | asufsagug(Agn)agcaauGfg Ufuuugcsusg | 61 | CAGCAAAACCAUUGCUUCACUAC | 62 |

TABLE 2B-continued

Human APP Modified Sequences, No "L96" Linker

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392712 | asusuua(Chd)UfcAfUfUf aucgccuuuu | 63 | asAfsaagg(Cgn)gauaauGfa Gfuaaauscsa | 64 | UGAUUUACUCAUUAUCGCCUUUU | 65 |
| AD-392713 | usascuc(Ahd)UfuAfUfCf gccuuuugau | 66 | asUfscaaa(Agn)ggcgauAfa Ufgaguasasa | 67 | uuuACuCAUUAUCGCCUUUUGAC | 68 |
| AD-392714 | usgsccu(Ghd)AfaCfUfUf gaauuaaucu | 69 | asGfsauua(Agn)uucaagUfu Cfaggcasusc | 70 | GAUGCCUGAACUUGAAUUAAUCC | 71 |
| AD-392715 | csusgaa(Chd)UfuGfAfAf uuaauccaca | 72 | usGfsugga(Tgn)uaauucAfa Gfuucagsgsc | 73 | GCCUGAACUUGAAUUAAUCCACA | 74 |
| AD-392716 | ususuag(Chd)UfgUfAfUf caaacuaguu | 75 | asAfscuag(Tgn)uugauaCfa Gfcuaaasusu | 76 | AAUUUAGCUGUAUCAAACuAGuG | 77 |
| AD-392717 | gsasaua(Ghd)AfuUfCfUf cuccugauua | 78 | usAfsauca(Ggn)gagagaAfu Cfuauucsasu | 79 | AuGAAUAGAUUCUCUCCUGAUUA | 80 |
| AD-392718 | uscscug(Ahd)UfuAfUfUf uaucacauau | 81 | asUfsaugu(Ggn)auaaauAfa Ufcaggasgsa | 82 | UCUCCUGAUUAUUUAUCACAUAG | 83 |
| AD-392719 | cscscaa(Uhd)UfaAfGfUf ccuacuuuau | 84 | asUfsaaag(Tgn)aggacuUfa Afuugggsusc | 85 | GACCCAAUUAAGUCCUACUUUAC | 86 |
| AD-392720 | csasuau(Ghd)CfuUfUfAf agaaucgauu | 87 | asAfsucga(Tgn)ucuuaaAfg Cfauaugsusa | 88 | UACAUAUGCUUUAAGAAUCGAUG | 89 |
| AD-392721 | csusucu(Chd)UfuGfCfCf uaaguauucu | 90 | asGfsaaua(Cgn)uuaggcAfa Gfagaagscsa | 91 | UGCUUCUCUUGCCUAAGUAUUCC | 92 |
| AD-392722 | csasuug(Chd)UfuAfUfGf acaugaucgu | 93 | asCfsgauc(Agn)ugucauAfa Gfcaaugsasu | 94 | AUCAUUGCUUAUGACAUGAUCGC | 95 |
| AD-392723 | csusuau(Ghd)AfcAfUfGf aucgcuuucu | 96 | asGfsaaag(Cgn)gaucauGfu Cfauaagscsa | 97 | UGCUUAUGACAUGAUCGCUUUCU | 98 |
| AD-392724 | usasuga(Chd)AfuGfAfUf cgcuuucuau | 99 | asufsagaa(Agn)gcgaucAfu Gfucauasasg | 100 | CUUAUGACAUGAUCGCUUUCUAC | 101 |
| AD-392725 | usgsaca(Uhd)GfaUfCfGf cuuucuacau | 102 | asufsguag(Agn)aagcgaUfc Afugucasusa | 103 | UAUGACAUGAUCGCUUUCUACAC | 104 |
| AD-392726 | gsasucg(Chd)UfuUfCfUf acacuguauu | 105 | asAfsuaca(Ggn)uguaghAfa Gfcgaucsasu | 106 | AUGAUCGCUUUCUACACUGUAUU | 107 |
| AD-392727 | asasaac(Uhd)AfuUfCfAf gaugacgucu | 108 | asGfsacgu(Cgn)aucugaAfu Afguuuusgsc | 109 | GCAAAACUAUUCAGAUGACGUCU | 110 |
| AD-392728 | asasacu(Ahd)UfuCfAfGf augacgucuu | 111 | asAfsgacg(Tgn)caucugAfa Ufaguuususg | 112 | CAAAACUAUUCAGAUGACGUCUU | 113 |
| AD-392729 | ascsgaa(Ahd)AfuCfCfAf accuacaagu | 114 | asCfsuugu(Agn)gguggAfu Ufuucgusasg | 115 | CUACGAAAAUCCAACCUACAAGU | 116 |
| AD-392730 | usgscuu(Chd)UfcUfUfGf ccuaaguauu | 117 | asAfsuacu(Tgn)aggcaaGfa Gfaagcasgsc | 118 | GCUGCUUCUCUUGCCUAAGUAUU | 119 |
| AD-392731 | usgscuu(Ahd)UfgAfCfAf ugaucgcuuu | 120 | asAfsagcg(Agn)ucaughCfa Ufaagcasasu | 121 | AUUGCUUAUGACAUGAUCGCUUU | 122 |
| AD-392732 | usgsauc(Ghd)CfuUfUfCf uacacuguau | 123 | asUfsacag(Tgn)guagaaAfg Cfgaucasusg | 124 | CAUGAUCGCUUUCUACACUGUAU | 125 |
| AD-392733 | asuscgc(Uhd)UfuCfUfAf cacuguauua | 126 | usAfsauac(Agn)guguaGfa Afgcgauscsa | 127 | UGAUCGCUUUCUACACUGUAUUA | 128 |
| AD-392734 | uscsuuu(Ghd)AfcCfGfAf aacgaaaacu | 129 | asGfsuuuu(Cgn)guuucgUfu Cfaaagasusg | 130 | CAUCUUUGACCGAAACGAAACC | 131 |
| AD-392735 | gsusucu(Ghd)GfgUfUfGf acaaauauca | 132 | usGfsauau(Tgn)ugucaaCfc Cfagaacscsu | 133 | AGGUUCUGGGUUGACAAAUAUCA | 134 |
| AD-392736 | usgsggu(Uhd)GfaCfAfAf auaucaagau | 135 | asufscuug(Agn)uauuugUfc Afacccasgsa | 136 | UCUGGGUUGACAAAUAUCAAGAC | 137 |

TABLE 2B-continued

Human APP Modified Sequences, No "L96" Linker

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392737 | gsasuuu(Ahd)CfuCfAfUf uaucgccuuu | 138 | asAfsaggc(Ggn)auaaugAfg Ufaaaucsasu | 139 | AUGAUUUACUCAUUAUCGCCUUU | 140 |
| AD-392738 | uscscuu(Uhd)CfcUfGfAf ucacuaugca | 141 | usGfscaua(Ggn)ugaucaGfg Afaaggasasu | 142 | AUUCCUUUCCUGAUCACUAUGCA | 143 |
| AD-392739 | csusuuc(Chd)UfgAfUfCf acuaugcauu | 144 | asAfsugca(Tgn)agugauCfa Gfgaaagsgsa | 145 | UCCUUUCCUGAUCACUAUGCAUU | 146 |
| AD-392740 | asusugc(Uhd)UfaUfGfAf caugaucgcu | 147 | asGfscgau(Cgn)augucaUfa Afgcaausgsa | 148 | UCAUUGCUUAUGACAUGAUCGCU | 149 |
| AD-392741 | uscsuuu(Ahd)AfcCfAfGf ucugaaguuu | 150 | asAfsacuu(Cgn)agacugGfh Ufaaagasasa | 151 | UUUCUUUAACCAGUCUGAAGUUU | 152 |
| AD-392742 | gsgsauc(Ahd)GfuUfAfCf ggaaacgauu | 153 | asAfsucgu(Tgn)uccguaAfc Ufgauccsusu | 154 | AAGGAUCAGUUACGGAAACGAUG | 155 |
| AD-392743 | csusggg(Uhd)UfgAfCfAf aauaucaaga | 156 | usCfsuuga(Tgn)auuuguCfa Afcccagsasa | 157 | UUCGGGUUGACAAAUAUCAAGA | 158 |
| AD-392744 | asusgau(Uhd)UfaCfUfCf auuaucgccu | 159 | asGfsgcga(Tgn)aaugagUfa Afaucausasa | 160 | UUAUGAUUUACUCAUUAUCGCCU | 161 |
| AD-392745 | csusugu(Ghd)GfuUTUfGf ugacccaauu | 162 | asAfsuugg(Ggn)ucacaaAfc Cfacaagsasa | 163 | UUCUUGUGGUUUGUGACCCAAUU | 164 |
| AD-392746 | asusaug(Chd)UfuUfAfAf gaaucgaugu | 165 | asCfsaucg(Agn)uucuuaAfa Gfcauausgsu | 166 | ACAUAUGCUUUAAGAAUCGAuGG | 167 |
| AD-392747 | ususugu(Chd)CfaCfGfUf aucuuugggu | 168 | asCfsccaa(Agn)gauacgUfg Gfacaaasasa | 169 | UUUUUGUCCACGUAUCUUUGGGU | 170 |
| AD-392748 | uscsauu(Ghd)UfaAfGfCf acuuuuacgu | 171 | asCfsguaa(Agn)agugcuUfa Cfaaugasasc | 172 | GUUCAUUGUAAGCACUUUUACGG | 173 |
| AD-392749 | gsgscca(Ahd)CfaUfGfAf uuagugaacu | 174 | asGfsuuca(Cgn)uaaucaUfg Ufuggccsasa | 175 | UUGGCCAACAUGAUUAGUGAACC | 176 |
| AD-392750 | gsasuca(Ghd)UfuAfCfGf gaaacgaugu | 177 | asCfsaucg(Tgn)uuccguAfa Cfugaucscsu | 178 | AGGAUCAGUUACGGAAACGAUGc | 179 |
| AD-392751 | usascgg(Ahd)AfaCfGfAf ugcucucauu | 180 | asAfsugag(Agn)gcaucgUfu Ufccguasasc | 181 | GuuACGGAAACGAUGCUCUCAUG | 182 |
| AD-392752 | usgsauu(Uhd)AfcUfCfAf uuaucgccuu | 183 | asAfsggcg(Agn)uaaugaGfu Afaaucasusa | 184 | UAUGAUUUACUCAUUAUCGCCUU | 185 |
| AD-392753 | gsusaga(Uhd)GfcCfUfGf aacuugaauu | 186 | asAfsuuca(Agn)guucagGfc Afucuacsusu | 187 | AAGUAGAUGCCUGAACUUGAAUU | 188 |
| AD-392754 | ususgua(Uhd)AfuUfAfUf cuugugguu | 189 | asAfsccac(Agn)agaauaAfu Afuacaascsu | 190 | AGUUGUAUAUUAUUCUUGUGGUU | 191 |
| AD-392755 | asusugc(Uhd)GfcUfUfCf ugcuauauuu | 192 | asAfsauau(Agn)gcagaaGfc Afgcaauscsu | 193 | AGAUUGCUGCUUCUGCUAUAUuu | 194 |
| AD-392756 | usgscua(Uhd)AfuUfGfUf ugauauagga | 195 | usCfscuau(Agn)ucacaaAfu Afuagcasgsa | 196 | UCUGCUAUAUUGUGAUAUAGGA | 197 |
| AD-392757 | ascsaca(Uhd)UfaGfGfCf auugagacuu | 198 | asAfsgucu(Cgn)aaugccUfa Afugugusgsc | 199 | GCACACAUUAGGCAUUGAGAcuu | 200 |
| AD-392758 | asasgaa(Uhd)CfcCfUfGf uucauuguaa | 201 | usUfsacaa(Tgn)gaacagGfg Afuucuususu | 202 | AAAAGAAUCCCUGUUCAUUGUAA | 203 |
| AD-392759 | csasuug(Uhd)AfaGfCfAf cuuuuacggu | 204 | asCfscgua(Agn)aagugcUfu Afcaaugsasa | 205 | UUCAUUGUAAGCACUUUUACGGG | 206 |
| AD-392760 | ususgcu(Uhd)AfuGfAfCf augaucgcuu | 207 | asAfsgcga(Tgn)caugucAfu Afagcaasusg | 208 | CAUUGCUUAUGACAUGAUCGCUU | 209 |
| AD-392761 | csasagg(Ahd)UfcAfGfUf uacggaaacu | 210 | asGfsuuuc(Cgn)guaacuGfa Ufccuugsgsu | 211 | ACCAAGGAUCAGUUACGGAAACG | 212 |

TABLE 2B-continued

Human APP Modified Sequences, No "L96" Linker

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392762 | asgsguu(Chd)UfgGfGfUf ugacaaauau | 213 | asUfsauuu(Ggn)ucaaccCfa Gfaaccusgsg | 214 | CCAGGUUCUGGGUUGACAAAUAU | 215 |
| AD-392763 | asasgau(Ghd)UfgGfGfUf ucaaacaaau | 216 | asUfsuugu(Tgn)ugaaccCfa Cfaucuuscsu | 217 | AGAAGAUGUGGGUUCAAACAAAG | 218 |
| AD-392764 | csusgaa(Ghd)AfaGfAfAf acaguacaca | 219 | usGfsugua(Cgn)uguuucUfu Cfuucagscsa | 220 | UGCUGAAGAAGAAACAGUACACA | 221 |
| AD-392765 | asasguu(Ghd)GfaCfAfGf caaaaccauu | 222 | asAfsuggu(Tgn)uugcugUfc Cfaacuuscsa | 223 | UGAAGUUGGACAGCAAAACCAUU | 224 |
| AD-392766 | asuscgg(Uhd)GfuCfCfAf uuuauagaau | 225 | asUfsucua(Tgn)aaauggAfc Afccgausgsg | 226 | CCAUCGGUGUCCAUUUAUAGAAU | 227 |
| AD-392767 | uscsggu(Ghd)UfcCfAfUf uuauagaaua | 228 | usAfsuucu(Agn)uaaaugGfa Cfaccgasusg | 229 | CAUCGGUGUCCAUUUAUAGAAUA | 230 |
| AD-392768 | gscsugu(Ahd)AfcAfCfAf aguagaugcu | 231 | asGfscauc(Tgn)acuuguGfu Ufacagcsasc | 232 | GUGCUGUAACACAAGUAGAUGCC | 233 |
| AD-392769 | asasgua(Ghd)AfuGfCfCf ugaacuugaa | 234 | usUfscaag(Tgn)ucaggcAfu Cfuacuusgsu | 235 | ACAAGUAGAUGCCUGAACUUGAA | 236 |
| AD-392770 | ususgug(Ghd)UfuUfGfUf gacccaauua | 237 | usAfsauug(Ggn)gucacaAfa Cfcacaasgsa | 238 | UCUUGUGGUUUGUGACCCAAUUA | 239 |
| AD-392771 | gsusuug(Uhd)GfaCfCfCf aauuaagucu | 240 | asGfsacuu(Agn)auugggUfc Afcaaacscsa | 241 | UGGUUUGUGACCCAAUUAAGUCC | 242 |
| AD-392772 | gsusgac(Chd)CfaAfUfUf aaguccuacu | 243 | asGfsuagg(Agn)cuuaauUfg Gfgucacsasa | 244 | UUGUGACCCAAUUAAGUCCUACU | 245 |
| AD-392773 | usasugc(Uhd)UfuAfAfGf aaucgauggu | 246 | asCfscauc(Ggn)auucuuAfa Afgcauasusg | 247 | CAUAUGCUUUAAGAAUCGAUGGG | 248 |
| AD-392774 | ususugu(Ghd)AfuAfUfAf ggaauuaaga | 249 | usCfsuuaa(Tgn)uccuauAfu Cfacaaasusa | 250 | UAUUUGUGAUAUAGGAAUUAAGA | 251 |
| AD-392775 | asasaga(Ahd)UfcCfCfUf guucauugua | 252 | usAfscaau(Ggn)aacaggGfa Ufucuuususc | 253 | GAAAAGAAUCCCUGUUCAUUGUA | 254 |
| AD-392776 | usgsauu(Ghd)UfaCfAfGf aaucauugcu | 255 | asGfscaau(Ggn)auucugUfa Cfaaucasusc | 256 | GAUGAUUGUACAGAAUCAUUGCU | 257 |
| AD-392777 | usgsccu(Ghd)GfaCfAfAf acccuucuuu | 258 | asAfsagaa(Ggn)gguuugUfc Cfaggcasusg | 259 | CAUGCCUGGACAAACCCUUCUUU | 260 |
| AD-392778 | gsasgca(Ahd)AfaCfUfAf uucagaugau | 261 | asUfscauc(Tgn)gaauagUfu Ufugcucsusu | 262 | AAGAGCAAAACUAUUCAGAUGAC | 263 |
| AD-392779 | asgsuga(Ahd)CfcAfAfGf gaucaguuau | 264 | asUfsaacu(Ggn)auccuuGfg Ufucacusasa | 265 | UUAGUGAACCAAGGAUCAGUUAC | 266 |
| AD-392780 | usgsaac(Chd)AfaGfGfAf ucaguuacgu | 267 | asCfsguaa(Cgn)ugauccUfu Gfguucascsu | 268 | AGUGAACCAAGGAUCAGUUAcGG | 269 |
| AD-392781 | csasguu(Ahd)CfgGfAfAf acgaugcucu | 270 | asGfsagca(Tgn)cguuucCfg Ufaacugsasu | 271 | AUCAGUUACGGAAACGAUGCUCU | 272 |
| AD-392782 | asgsaag(Ahd)UfgUfGfGf guucaaacaa | 273 | usUfsguuu(Ggn)aacccCfa Ufcuucusgsc | 274 | GCAGAAGAUGUGGGUUCAAACAA | 275 |
| AD-392783 | cscsucu(Ghd)AfaGfUfUf ggacagcaaa | 276 | usUfsugcu(Ggn)uccaacUfu Cfagaggscsu | 277 | AGCCUCUGAAGUUGGACAGCAAA | 278 |
| AD-392784 | ususaug(Ahd)UfuUfAfCf ucauuaucgu | 279 | ascfsgaua(Agn)ugaguaAfa Ufcauaasasa | 280 | UUUUAUGAUUUACUCAUUAUCGC | 281 |
| AD-392785 | ascsagc(Uhd)GfuGfCfUf guaacacaau | 282 | asUfsugug(Tgn)uacagcAfc Afgcugsscsa | 283 | UGACAGCUGUGCUGUAACACAAG | 284 |
| AD-392786 | usgsuga(Chd)CfcAfAfUf uaaguccuau | 285 | asufsagga(Cgn)uuaauuGfg Gfucacasasa | 286 | UUUGUGACCCAAUUAAGUCCUAC | 287 |

TABLE 2B-continued

Human APP Modified Sequences, No "L96" Linker

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392787 | usascau(Ahd)UfgCfUfUf uaagaaucga | 288 | usCfsgauu(Cgn)uuaaagCfa Ufauguasasa | 289 | UUUACAUAUGCUUUAAGAAUCGA | 290 |
| AD-392788 | gsusaaa(Uhd)AfaAfUfAf cauucuugga | 291 | usCfscaag(Agn)auguauUfu Afuuuacsasu | 292 | AUGUAAAUAAAUACAUUCUUGGA | 293 |
| AD-392789 | uscsagu(Uhd)AfcGfGfAf aacgaugcuu | 294 | asAfsgcau(Cgn)guuuccGfu Afacugasusc | 295 | GAUCAGUUACGGAAACGAUGCUC | 296 |
| AD-392790 | csusucc(Chd)GfuGfAfAf uggagaguuu | 297 | asAfsacuc(Tgn)ccauucAfc Gfggaagsgsa | 298 | UCCUUCCCGUGAAUGGAGAGUUC | 299 |
| AD-392791 | asgsuug(Ghd)AfcAfGfCf aaaaccauuu | 300 | asAfsaugg(Tgn)uuugcuGfu Cfcaacususc | 301 | GAAGUUGGACAGCAAAACCAUUG | 302 |
| AD-392792 | cscscau(Chd)GfgUfGfUf ccauuuauau | 303 | asUfsauaa(Agn)uggacaCfc Gfaugggsusa | 304 | UACCCAUCGGUGUCCAUUUAUAG | 305 |
| AD-392793 | usgscac(Ahd)CfaUfUfAf ggcauugaga | 306 | usCfsucaa(Tgn)gccuaaUfg Ufgugcascsa | 307 | UGUGCACACAUUAGGCAUUGAGA | 308 |
| AD-392794 | cscsaac(Ahd)UfgAfUfUf agugaaccaa | 309 | usufsgguu(Cgn)acuaauCfa Ufguuggscsc | 310 | GGCCAACAUGAUUAGUGAACCAA | 311 |
| AD-392795 | asusgau(Uhd)AfgUfGfAf accaaggauu | 312 | asAfsuccu(Tgn)gguucaCfu Afaucausgsu | 313 | ACAUGAUUAGUGAACCAAGGAUC | 314 |
| AD-392796 | ususagu(Ghd)AfaCfCfAf aggaucaguu | 315 | asAfscuga(Tgn)ccuggUfu Cfacuaasusc | 316 | GAUUAGUGAACCAAGGAUCAGUU | 317 |
| AD-392797 | asascca(Ahd)GfgAfUfCf aguuacggaa | 318 | usUfsccgu(Agn)acugauCfc Ufugguuscsa | 319 | uGAACCAAGGAUCAGUUACGGAA | 320 |
| AD-392798 | gsusuac(Ghd)GfaAfAfCf gaugcucuca | 321 | usGfsagag(Cgn)aucguuUfc Cfguaacsusg | 322 | CAGUUACGGAAACGAUGCUCUCA | 323 |
| AD-392799 | gsasugc(Ahd)GfaAfUfUf ccgacaugau | 324 | asUfscaug(Tgn)cggaauUfc Ufgcaucscsa | 325 | uGGAUGCAGAAUUCCGACAUGAC | 326 |
| AD-392800 | ususgga(Chd)AfgCfAfAf aaccauugcu | 327 | asGfscaau(Ggn)guuugCfu Gfuccaascsu | 328 | AGUUGGACAGCAAAACCAUUGCU | 329 |
| AD-392801 | asasacc(Ahd)UfuGfCfUf ucacuaccca | 330 | usGfsggua(Ggn)ugaagcAfa Ufgguuususg | 331 | CAAAACCAUUGCUUCACUACCCA | 332 |
| AD-392802 | cscsauc(Ghd)GfuGfUfCf cauuuauaga | 333 | usCfsuaua(Agn)auggacAfc Cfgauggsgsu | 334 | ACCCAUCGGUGUCCAUUUAUAGA | 335 |
| AD-392803 | ususauc(Ghd)CfcUfUfUf ugacagcugu | 336 | asCfsagcu(Ggn)ucaaaaGfg Cfgauaasusg | 337 | CAUUAUCGCCUUUUGACAGCUGU | 338 |
| AD-392804 | asuscgc(Chd)UfuUfUfGf acagcugugu | 339 | asCfsacag(Cgn)ugucaaAfa Gfgcgausasa | 340 | UUAUCGCCUUUUGACAGCUGUGC | 341 |
| AD-392805 | ascsaca(Ahd)GfuAfGfAf ugccugaacu | 342 | asGfsuuca(Ggn)gcaucuAfc Ufugugususa | 343 | UAACACAAGUAGAUGCCUGAACU | 344 |
| AD-392806 | usgsugg(Uhd)UfuGfUfGf acccaauuaa | 345 | usufsaauu(Ggn)ggucacAfa Afccacasasg | 346 | CUUGUGGUUUGUGACCCAAUUAA | 347 |
| AD-392807 | gsgsgau(Ghd)CfuUfCfAf ugugaacguu | 348 | asAfscguu(Cgn)acaugaAfg Cfaucccscsc | 349 | GGGGGAUGCUUCAUGUGAACGUG | 350 |
| AD-392808 | usgsugc(Ahd)CfaCfAfUf uaggcauuga | 351 | usCfsaaug(Cgn)cuaaugUfg Ufgcacasusa | 352 | UAUGUGCACACAUUAGGCAUUGA | 353 |
| AD-392809 | asasaug(Ahd)AfaGfUfGf gcaauauaau | 354 | asUfsuaua(Tgn)ugccacUfu Cfcauuususc | 355 | GAAAUGGAAGUGGCAAUAUAAG | 356 |
| AD-392810 | asusgga(Ahd)GfuGfGfCf aauauaaggu | 357 | asCfscuua(Tgn)auugccAfc Ufuccaususu | 358 | AAAUGGAAGUGGCAAUAUAAGGG | 359 |
| AD-392811 | usgsccc(Ghd)AfgAfUfCf uguuaaacu | 360 | asGfsuuua(Agn)caggauCfu Cfgggcasasg | 361 | CUUGCCCGAGAUCCUGUUAAACU | 362 |

TABLE 2B-continued

Human APP Modified Sequences, No "L96" Linker

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392812 | asusuag(Uhd)GfaAfCfCf aaggaucagu | 363 | asCfsugau(Cgn)cuugguUfc Afcuaauscsa | 364 | UGAUUAGUGAACCAAGGAUCAGU | 365 |
| AD-392813 | gsasacc(Ahd)AfgGfAfUf caguuacgga | 366 | usCfscgua(Agn)cugaucCfu Ufgguucsasc | 367 | GUGAACCAAGGAUCAGUUACGGA | 368 |
| AD-392814 | asasgga(Uhd)CfaGfUfUf acggaaacga | 369 | usCfsguuu(Cgn)cguaacUfg Afccuusgsg | 370 | CCAAGGAUCAGUUACGGAAACGA | 371 |
| AD-392815 | csasaca(Chd)AfgAfAfAf acgaaguuga | 372 | usCfsaacu(Tgn)cguuuuCfu Gfuguugsgsc | 373 | GCCAACACAGAAAACGAAGUUGA | 374 |
| AD-392816 | usgsggu(Uhd)CfaAfAfCf aaaggugcaa | 375 | usUfsgcac(Cgn)uuuguuUfg Afacccascsa | 376 | UGUGGGUUCAAACAAAGGUGCAA | 377 |
| AD-392817 | csasgug(Ahd)UfcGfUfCf aucaccuugu | 378 | ascfsaagg(Tgn)gaugacGfa Ufcacugsusc | 379 | GACAGUGAUCGUCAUCACCUUGG | 380 |
| AD-392818 | ascscca(Uhd)CfgGfUfGf uccauuuaua | 381 | usAfsuaaa(Tgn)ggacacCfg Afugggusasg | 382 | CUACCCAUCGGUGUCCAUUUAUA | 383 |
| AD-392819 | uscsuug(Uhd)GfgUfUfUf gugacccaau | 384 | asUfsuggg(Tgn)cachaaCfc Afcaagasasu | 385 | AUUCUUGUGGUUUGUGACCCAAU | 386 |
| AD-392820 | ususugu(Ghd)AfcCfCfAf auuaagaguccu | 387 | asGfsgacu(Tgn)aauuggGfu Cfacaaascsc | 388 | GGUUUGUGACCCAAUUAAGUCCU | 389 |
| AD-392821 | ususgug(Ahd)CfcCfAfAf uuaaguccua | 390 | usAfsggac(Tgn)uhahugGfg Ufcachasasc | 391 | GUUUGUGACCCAAUUAAGUCCUA | 392 |
| AD-392822 | ususcag(Uhd)UfgAfCfGf ucuuggccaa | 393 | usUfsggcc(Agn)agacguCfa Ufcugaasusa | 394 | UAUUCAGAUGACGUCUUGGCCAA | 395 |
| AD-392823 | asuscag(Uhd)UfaCfGfGf aaacgaugcu | 396 | asGfscauc(Ggn)uuuccgUfa Afcugauscsc | 397 | GGAUCAGUUACGGAAACGAUGCU | 398 |
| AD-392824 | usgsgau(Ghd)CfaGfAfAf uuccgacauu | 399 | asAfsuguc(Ggn)gaauucUfg Cfauccasusc | 400 | GAUGGAUGCAGAAUUCCGACAUG | 401 |
| AD-392825 | gsuscca(Ahd)GfaUfGfCf agcagaacgu | 402 | asCfsguuc(Tgn)gcugcaUfc Ufuggacsasg | 403 | CUGUCCAAGAUGCAGCAGAACGG | 404 |
| AD-392826 | usasccc(Ahd)UfcGfGfUf guccauuuau | 405 | asUfsaaau(Ggn)gacaccGfa Ufgggasgsu | 406 | ACUACCCAUCGGUGUCCAUUUAU | 407 |
| AD-392827 | ususuug(Ahd)CfaGfCfUf gugcuguaau | 408 | asUfsuaca(Ggn)cacagcUfg Ufcaaaasgsg | 409 | CCUUUUGACAGCUGUGCUGUAAC | 410 |
| AD-392828 | ususgac(Ahd)GfcUfGfUf gcuguaacau | 411 | asUfsgtma(Cgn)agcacaGfc Ufgucaasasa | 412 | UUUUGACAGCUGUGCUGUAACAC | 413 |
| AD-392829 | asgscug(Uhd)GfcUfGfUf aacacaagua | 414 | usAfscuug(Tgn)guuacaGfc Afcagcusgsu | 415 | ACAGCUGUGCUGUAACACAAGUA | 416 |
| AD-392830 | gsusuuu(Ahd)UfgUfGfCf acacauuagu | 417 | asCfsuaau(Ggn)ugugcaCfa Ufaaaacsasg | 418 | CUGUUUUAUGUGCACACAUUAGG | 419 |
| AD-392831 | ususcaa(Uhd)UfaCfCfAf agaauucucu | 420 | usGfsagaa(Tgn)ucuuggUfa Afuugaasgsa | 421 | UCUUCAAUUACCAAGAAUUCUCC | 422 |
| AD-392832 | csascac(Ahd)UfcAfGfUf aauguauucu | 423 | asGfsaaua(Cgn)auuacuGfa Ufgugugsgsa | 424 | UCCACACAUCAGUAAUGUAUUCU | 425 |
| AD-392833 | usgsguc(Uhd)CfuAfUfAf cuacauuauu | 426 | asAfsuaau(Ggn)uaguauAfg Afgaccasasa | 427 | UUUGGUCUCUAUACUACAUUAUU | 428 |
| AD-392834 | ascsccg(Uhd)UfuUfAfUf gauuuacuca | 429 | usGfsagua(Agn)aucauaAfa Afcgggususu | 430 | AAACCCGUUUUAUGAUUUACUCA | 431 |
| AD-392835 | usascga(Ahd)AfaUfCfCf aaccuacaau | 432 | asUfsgua(Ggn)guuggaUfu Ufucguasgsc | 433 | GCUACGAAAAUCCAACCUACAAG | 434 |
| AD-392836 | uscscac(Ahd)CfaUfCfAf guaauguauu | 435 | asAfsuaca(Tgn)uacugaUfg Ufguggasusu | 436 | AAUCCACACAUCAGUAAUGUAUU | 437 |

TABLE 2B-continued

Human APP Modified Sequences, No "L96" Linker

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392837 | csusggu(Chd)UfuCfAfAf uuaccaagaa | 438 | usufscuug(Ggn)uaauugAfa Gfaccagscsa | 439 | UGCUGGUCUUCAAUUACCAAGAA | 440 |
| AD-392838 | gscscau(Chd)UfuUfGfAf ccgaaacgaa | 441 | usUfscguu(Tgn)cggucaAfa Gfauggcsasu | 442 | AUGCCAUCUUUGACCGAAACGAA | 443 |
| AD-392839 | cscsauc(Uhd)UfuGfAfCf cgaaacgaaa | 444 | usUfsucgu(Tgn)ucggucAfa Afgauggscsa | 445 | UGCCAUCUUUGACCGAAACGAAA | 446 |
| AD-392840 | csusacg(Ahd)AfaAfUfCf caaccuacaa | 447 | usUfsguag(Ggn)uuggauUfu Ufcguagscsc | 448 | GGCUACGAAAAUCCAACCUACAA | 449 |
| AD-392841 | asuscca(Chd)AfcAfUfCf aguaauguau | 450 | asUfsacau(Tgn)acugauGfu Gfuggaususa | 451 | UAAUCCACACAUCAGUAAUGUAU | 452 |
| AD-392842 | csasugc(Chd)AfuCfUfUf ugaccgaaau | 453 | asufsuucg(Ggn)ucaaagAfu Gfcaugsasg | 454 | CUCAUGCCAUCUUUGACCGAAAC | 455 |
| AD-392843 | gsgscua(Chd)GfaAfAfAf uccaaccuau | 456 | asUfsaggu(Tgn)ggauuuUfc Gfuagccsgsu | 457 | ACGGCUACGAAAAUCCAACCUAC | 458 |
| AD-392844 | uscsaug(Chd)CfaUfCfUf uugaccgaaa | 459 | usufsucgg(Tgn)caaagaUfg Gfcaugasgsa | 460 | UCUCAUGCCAUCUUUGACCGAAA | 461 |
| AD-392845 | csasgua(Chd)AfcAfUfCf cauucaucau | 462 | asUfsgaug(Agn)auggauGfu Gfuacugsusu | 463 | AACAGUACACAUCCAUUCAUCAU | 464 |
| AD-392846 | asascgg(Chd)UfaCfGfAf aaauccaacu | 465 | asGfsuugg(Agn)uuucgUfa Gfccguuscsu | 466 | AGAACGGCUACGAAAAUCCAACC | 467 |
| AD-392847 | gsasagu(Uhd)UfcAfUfUf auagauacaa | 468 | usUfsguau(Cgn)auaaauGfa Afacuucsasg | 469 | CUGAAGUUUCAUUUAUGAUACAA | 470 |
| AD-392848 | asusgcc(Ahd)UfcUfUfUf gaccgaaacu | 471 | asGfsuuuc(Ggn)gucaaaGfa Ufggcausgsa | 472 | UCAUGCCAUCUUUGACCGAAACG | 473 |
| AD-392849 | gsasacg(Ghd)CfuAfCfGf aaaauccaau | 474 | asUfsugga(Tgn)uuucguAfg Cfcguucsusg | 475 | CAGAACGGCUACGAAAAUCCAAC | 476 |
| AD-392850 | uscsuuc(Ghd)UfgCfCfUf guuuauguu | 477 | asAfscaua(Agn)aacaggCfa Cfgaagasasa | 478 | UUUCUUCGUGCCUGUUUUAUGUG | 479 |
| AD-392851 | ususgcc(Chd)GfaGfAfUf ccuguuaaau | 480 | asUfsuuaa(Cgn)aggaucUfc Gfggcaasgsa | 481 | UCUUGCCCGAGAUCCUGUUAAAC | 482 |
| AD-392852 | csusucg(Uhd)GfcCfUfGf uuuuauguau | 483 | asCfsacau(Agn)aaacagGfc Afcgaagasasa | 484 | UUCUUCGUGCCUGUUUUAUGUGC | 485 |
| AD-392853 | gscsgcc(Ahd)UfgUfCfCf caaaguuuau | 486 | asUfsaaac(Tgn)uugggaCfa Ufggcgcsusg | 487 | CAGCGCCAUGUCCCAAAGUUUAC | 488 |
| AD-392854 | gsuscau(Ahd)GfcGfAfCf agugaucguu | 489 | asAfscgau(Cgn)acugcGfc Ufaugacsasa | 490 | UUGUCAUAGCGACAGUGAUCGUC | 491 |
| AD-392855 | gscsuac(Ghd)AfaAfAfUf ccaaccuaca | 492 | usGfsuagg(Tgn)uggauuUfu Cfguagcscsg | 493 | CGGCUACGAAAAUCCAACCUACA | 494 |
| AD-392856 | asusagc(Ghd)AfcAfGfUf gaucgucauu | 495 | asAfsugac(Ggn)aucacuGfu Cfgcuausgsa | 496 | UCAUAGCGACAGUGAUCGUCAUC | 497 |
| AD-392857 | csusugc(Chd)CfgAfGfAf uccuguuaaa | 498 | usUfsuaac(Agn)ggaucCfg Gfgcaagsasg | 499 | CUCUUGCCCGAGAUCCUGUUAAA | 500 |
| AD-392858 | csuscau(Chd)CfcAfUfCf uuugaccgaa | 501 | usUfsccgu(Cgn)aaagauGfg Cfaugagsasg | 502 | CUCUCAUGCCAUCUUUGACCGAA | 503 |
| AD-392859 | ascsggc(Uhd)AfcGfAfAf aauccaaccu | 504 | asGfsguug(Ggn)auuucGfu Afgccgususc | 505 | GAACGGCUACGAAAAUCCAACCU | 506 |
| AD-392860 | csasuca(Ahd)AfaAfUfUf ggugucuuu | 507 | asAfsagaa(Cgn)accaauUfu Ufugaugsasu | 508 | AUCAUCAAAAAUUGGUGUUCUUU | 509 |
| AD-392861 | asuscca(Ahd)CfcUfAfCf aaguucuuug | 510 | csAfsaaga(Agn)cuuguaGfg Ufuggausus | 511 | AAAUCCAACCUACAAGUUCUUUG | 512 |

TABLE 2B-continued

Human APP Modified Sequences, No "L96" Linker

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392862 | csgscuu(Uhd)CfuAfCfAf cguauuaca | 513 | usGfsuaau(Agn)cagugu Afg Afaagcgsasu | 514 | AUCGCUUUCUACACUGUAUUACA | 515 |
| AD-392863 | uscscaa(Chd)CfuAfCfAf aguucuuuga | 516 | usCfsaaag(Agn)acugu Afg Gfuuggasusu | 517 | AAUCCAACCUACAAGUUCUUUGA | 518 |
| AD-392864 | uscsucu(Chd)UfuUfAfCf auuuuggucu | 519 | asGfsacca(Agn)aaugu Afa Gfagagasasa | 520 | UAUCUCUCUUUACAUUUUGGUCU | 521 |
| AD-392865 | csuscuc(Uhd)UfuAfCfAf uuuuggucuu | 522 | asAfsgacc(Agn)aaaugu Afa Afgagagsasu | 523 | AUCUCUCUUUACAUUUUGGUCUC | 524 |
| AD-392866 | ususugu(Ghd)UfaCfUfGf uaaagaauuu | 525 | asAfsauuc(Tgn)uuacag Ufa Cfacaaasasc | 526 | GUUUUGUGUACUGUAAAGAAUUU | 527 |
| AD-392867 | gsusgua(Chd)UfgUfAfAf agaauuuagu | 528 | asCfsuaaa(Tgn)ucuuua Cfa Gfuacacsasa | 529 | UUGUGUACUGUAAAGAAUUUAGC | 530 |
| AD-392868 | ascscca(Ahd)UfuAfAfGf uccuacuuua | 531 | usAfsaagu(Agn)ggacuu Afa Ufuggguscsa | 532 | UGACCCAAUUAAGUCCUACUUUA | 533 |
| AD-392869 | uscscua(Chd)UfuUfAfCf auaugcuuua | 534 | usAfsaagc(Agn)uauguh Afa Gfuaggascsu | 535 | AGUCCUACUUUACAUAUGCUUUA | 536 |
| AD-392870 | cscsuac(Uhd)UfuAfCfAf uaugcuuuaa | 537 | usUfsaaag(Cgn)auaugu Afa Afguaggsasc | 538 | GUCCUACUUUACAUAUGCUUUAA | 539 |
| AD-392871 | ususcua(Chd)AfcUfGfUf auuacauaaa | 540 | usUfsuaug(Tgn)aauaca Gfu Gfuagaasasg | 541 | CUUUCUACACUGUAUUACAUAAA | 542 |
| AD-392872 | uscsuac(Ahd)CfuGfUfAf uuacauaaau | 543 | asUfsuuau(Ggn)uauacAfg Ufguagasasa | 544 | UUUCUACACUGUAUUACAUAAAU | 545 |
| AD-392873 | csusuuu(Ahd)AfgAfUfGf ugcuucaau | 546 | asUfsugaa(Ggn)acacau Cfu Ufaaaagsasa | 547 | UUCUUUUAAGAUGUGUCUUCAUU | 548 |
| AD-392874 | asusgug(Uhd)CfuUfCfAf auuuguauaa | 549 | usUfsauac(Agn)aauuga Afg Afcacauscsu | 550 | AGAUGUGUCUUCAAUUUGUAUAA | 551 |
| AD-392875 | asuscaa(Ahd)AfaUfUfGf uguucuuug | 552 | csAfsaaga(Agn)caccaa Ufu Ufuugausgsa | 553 | UCAUCAAAAUUGGUGUUCUUUG | 554 |
| AD-392876 | asasauc(Chd)AfaCfCfUf acaaguucuu | 555 | asAfsgaac(Tgn)uguaggUfu Gfgauuususc | 556 | GAAAAUCCAACCUACAAGUUCUU | 557 |
| AD-392877 | gsusacu(Ghd)UfaAfAfGf aauuuagcuu | 558 | asAfsgcua(Agn)uaaauAfu Cfaggagsasg | 559 | GUGUACUGUAAAGAAUUUAGCUG | 560 |
| AD-392878 | csusccu(Ghd)AfuUfAfUf uuaucacaua | 561 | usAfsugug(Agn)uaaauAfu Cfaggagsasg | 562 | CUCUCCUGAUUAUUUAUCACAUA | 563 |
| AD-392879 | gscscag(Uhd)UfgUfAfUf auuauucuuu | 564 | asAfsagaa(Tgn)aauauaCfa Afcuggcsusa | 565 | UAGCCAGUUGUAUAUUAUUCUUG | 566 |
| AD-392880 | asasuua(Ahd)GfuCfCfUf acuuuacaua | 567 | usAfsugua(Agn)aguaggAfc Ufuaauusgsg | 568 | CCAAUUAAGUCCUACUUUACAUA | 569 |
| AD-392881 | csusugc(Chd)UfaAfGfUf auuccuuucu | 570 | asGfsaaag(Ggn)aauacuUfa Gfgcaagsasg | 571 | CUCUUGCCUAAGUAUUCCUUUCC | 572 |
| AD-392882 | asusucc(Uhd)UfuCfCfUf gaucacuauu | 573 | asAfsuagu(Ggn)aucaggAfa Afggaausasc | 574 | GUAUUCCUUUCCUGAUCACUAUG | 575 |
| AD-392883 | ascsuau(Ghd)CfaUfUfUf uaaaguuaaa | 576 | usUfsuaac(Tgn)uuaaaaUfg Cfauagusgsa | 577 | UCACUAUGCAUUUAAAGUUAAA | 578 |
| AD-392884 | usgsuuc(Ahd)UfuGfUfAf agcacuuuua | 579 | usAfsaaag(Tgn)gcuuacAfa Ufgaacasgsg | 580 | CCUGUUCAUUGUAAGCACUUUUA | 581 |
| AD-392885 | asasuua(Chd)CfaAfGfAf auucuccaaa | 582 | usUfsugga(Ggn)aauucuUfg Gfuaauusgsa | 583 | UCAAUUACCAAGAAUUCUCCAAA | 584 |
| AD-392886 | ususacc(Ahd)AfgAfAfUf ucuccaaaau | 585 | asUfsuuug(Ggn)agaauuCfu Ufgguaasusu | 580 | AAUUACCAAGAAUUCUCCAAAAC | 587 |

TABLE 2B-continued

Human APP Modified Sequences, No "L96" Linker

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392887 | uscsauu(Ghd)CfuUfAfUf gacaugaucu | 588 | asGfsauca(Tgn)gucauaAfg Cfaaugasusu | 589 | AAUCAUUGCUUAUGACAUGAUCG | 590 |
| AD-392889 | ususuua(Ahd)GfaUfGfUf gucuucaauu | 591 | asAfsuuga(Agn)gacacaUfc Ufuaaaasgsa | 592 | UCUUUUAAGAUGUGUCUUCAAUU | 593 |
| AD-392890 | asusccu(Ghd)UfuAfAfAf cuuccuacaa | 594 | usUfsguag(Ggn)aaguuuAfa Cfaggauscsu | 595 | AGAUCCUGUUAAACUUCCUACAA | 596 |
| AD-392891 | ascsuau(Uhd)CfaGfAfUf gacgucuugu | 597 | asCfsaaga(Cgn)gucaucUfg Afauagususu | 598 | AAACUAUUCAGAUGACGUCUUGG | 599 |
| AD-392892 | gsusuca(Uhd)CfaUfCfAf aaaauugguu | 600 | asAfsccaa(Tgn)uuuugaUfg Afugaacsusu | 601 | AAGUUCAUCAUCAAAAAUUGGUG | 602 |
| AD-392893 | usasucu(Chd)UfcUfUfUf acauuuugu | 603 | asCfscaaa(Agn)uguaaaGfa Gfagauasgsa | 604 | UCUAUCUCUCUUUACAUUUUGGU | 605 |
| AD-392894 | asuscuc(Uhd)CfuUfUfAf cauuuugguu | 606 | asAfsccaa(Agn)auguaaAfg Afgagausasg | 607 | CUAUCUCUCUUUACAUUUUGGUC | 608 |
| AD-392895 | usgsugu(Ahd)CfuGfUfAf aagaauuuau | 609 | asUfsaaau(Tgn)cuuuacAfg Ufacacasasa | 610 | UUUGUGUACUGUAAAGAAUUUAG | 611 |
| AD-392896 | csusacu(Uhd)UfaCfAfUf augcuuuaau | 612 | asUfsuaaa(Ggn)cauaugUfa Afaguagsgsa | 613 | UCCUACUUUACAUAUGCUUUAAG | 614 |
| AD-392897 | usgsccu(Ahd)AfgUfAfUf uccuuuccuu | 615 | asAfsggaa(Agn)ggaauaCfu Ufaggcasasg | 616 | CUUGCCUAAGUAUUCCUUUCCUG | 617 |
| AD-392898 | asasgua(Uhd)UfcCfUfUf uccugaucau | 618 | asUfsgauc(Agn)ggaaagGfa Afuacuusasg | 619 | CUAAGUAUUCCUUUCCUGAUCAC | 620 |
| AD-392899 | gsusauu(Chd)CfhaUfCf cugaucacua | 621 | usAfsguga(Tgn)caggaaAfg Gfaauacsusu | 622 | AAGUAUUCCUUUCCUGAUCACUA | 623 |
| AD-392900 | ususccu(Ghd)AfuCfAfCf uaugcauuuu | 624 | asAfsaaug(Cgn)auagugAfu Cfaggaasasg | 625 | CUUUCCUGAUCACUAUGCAUUUU | 626 |
| AD-392901 | csusgau(Chd)AfcUfAfUf gcauuuuaaa | 627 | usufsuaaa(Agn)ugcauaGfu Gfaucagsgsa | 628 | UCCUGAUCACUAUGCAUUUUAAA | 629 |
| AD-392902 | csascgu(Ahd)UfcUfUfUf gggucuuuga | 630 | usCfsaaag(Agn)cccaaaGfa Ufacgugsgsa | 631 | UCCACGUAUCUUUGGGUCUUUGA | 632 |
| AD-392903 | usgsggu(Chd)UfuUfGfAf uaaagaaaau | 633 | asUfsuuuc(Tgn)uuaucaAfa Gfacccasasa | 634 | UUUGGGUCUUUGAUAAAGAAAAG | 635 |
| AD-392904 | uscsaau(Uhd)AfcCfAfAf gaauucucca | 636 | usGfsgaga(Agn)uucuugGfu Afauugasasg | 637 | CUUCAAUUACCAAGAAUUCUCCA | 638 |
| AD-392906 | uscsgcu(Uhd)UfcUfAfCf acuguauau | 639 | asUfsaaua(Cgn)aguuaGfa Afagcgasusc | 640 | GAUCGCUUUCUACACUGUAUUAC | 641 |
| AD-392907 | asusuuu(Chd)UfuUfAfAf ccagucugaa | 642 | usUfscaga(Cgn)ugguuaAfa Gfaaaausssg | 643 | CAAUUUUCUUUAACCAGUCUGAA | 644 |
| AD-392908 | csusuua(Ahd)CfcAfGfUf cugaaguuuc | 645 | gsAfsaacu(Tgn)cagacuGfg Ufuaaagsasa | 646 | UUCUUUAACCAGUCUGAAGUUUC | 647 |
| AD-392909 | usasaga(Uhd)GfuGfUfCf uucaauuugu | 648 | asCfsaaau(Tgn)gaagacAfc Afucuuasasa | 649 | UUUAAGAUGUGUCUUCAAUUUGU | 650 |
| AD-392910 | gsasucc(Uhd)GfuUfAfAf acuuccuaca | 651 | usGfsuagg(Agn)aguuuAfc Afggaucsusc | 652 | GAGAUCCUGUUAAACUUCCUACA | 653 |
| AD-392911 | csusgcu(Uhd)CfaGfAfAf agagcaaaau | 654 | asUfsuuug(Cgn)ucuuucUfg Afagcagscsu | 655 | AGCUGCUUCAGAAAGAGCAAAAC | 656 |
| AD-392912 | csasgaa(Ahd)GfaGfCfAf aaacuauuca | 657 | usGfsaaua(Ggn)uuuugcUfc Ufuucugsasa | 658 | UUCAGAAAGAGCAAAACUAUUCA | 659 |
| AD-392913 | usasuga(Ahd)GfuUfCfAf ucaucaaaaa | 660 | ususfsuuug(Agn)ugaugaAfc Ufcauasusc | 661 | GAUAUGAAGUUCAUCAUCAAAAA | 662 |

TABLE 2B-continued

Human APP Modified Sequences, No "L96" Linker

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392914 | csasuca(Uhd)CfaAfAfAf auugguguuu | 663 | asAfsacac(Cgn)aauuuuUfg Afugaugsasa | 664 | UUCAUCAUCAAAAAUUGGUGUUC | 665 |
| AD-392915 | uscsaaa(Ahd)AfuUfGfGf uguucuuugu | 666 | asCfsaaag(Agn)acaccaAfu Ufuuugasusg | 667 | CAUCAAAAAUUGGUGUUCUUUGC | 668 |
| AD-392916 | asasaau(Chd)CfaAfCfCf ucaaguucu | 669 | asGfsaacu(Tgn)guagguUfg Gfauuuuscsg | 670 | CGAAAAUCCAACCUACAAGUUCU | 671 |
| AD-392917 | cscsaac(Chd)UfaCfAfAf guucuuugau | 672 | asUfscaaa(Ggn)aacuugUfa Gfguuggsasu | 673 | AUCCAACCUACAAGUUCUUUGAG | 674 |
| AD-392918 | ascsuca(Uhd)UfaUfCfGf ccuuuugaca | 675 | usGfsucaa(Agn)aggcgaUfa Afugagsasa | 676 | UUACUCAUUAUCGCCUUUUGACA | 677 |
| AD-392919 | csuscau(Uhd)AfuCfGfCf cuuuugacau | 678 | asufsguca(Agn)aaggcgAfu Afaugagsusa | 679 | UACUCAUUAUCGCCUUUUGACAG | 680 |
| AD-392920 | usgsugc(Uhd)GfuAfAfCf acaaguagau | 681 | asUfscuac(Tgn)uguguuAfc Afgcacasgsc | 682 | GCUGUGCUGUAACACAAGUAGAU | 683 |
| AD-392921 | gsusgcu(Ghd)UfaAfCfAf caaguagauu | 684 | asAfsucua(Cgn)uuguguUfa Cfagcacsasg | 685 | CUGUGCUGUAACACAAGUAGAUG | 686 |
| AD-392922 | uscsuuu(Ahd)CfaUfUfUf uggucucuau | 687 | asUfsagag(Agn)ccaaaaUfg Ufaaagasgsa | 688 | UCUCUUUACAUUUUGGUCUCUAU | 689 |
| AD-392923 | asusggg(Uhd)UfuUfGfUf guacuguaaa | 690 | usUfsuaca(Ggn)uacacaAfa Afcccaususa | 691 | UAAUGGGUUUUGUGUACUGUAAA | 692 |
| AD-392924 | ususgug(Uhd)AfcUfGfUf aaagaauuua | 693 | usAfsaauu(Cgn)uuuacaGfu Afcacaasasa | 694 | UUUUGUGUACUGUAAAGAAUUUA | 695 |
| AD-392925 | gscsugu(Ahd)UfcAfAfAf cuagugcauu | 696 | asAfsugca(Cgn)uaguuuGfa Ufacagcsusa | 697 | UAGCUGUAUCAAACUAGUGCAUG | 698 |
| AD-392926 | csusagu(Ghd)CfaUfGfAf auagauucuu | 699 | asAfsgaau(Cgn)uauucaUfg Cfacuagsusu | 700 | AACUAGUGCAUGAAUAGAUUCUC | 701 |
| AD-392927 | usasgug(Chd)AfuGfAfAf uagauucucu | 702 | asGfsagaa(Tgn)cuauucAfu Gfcacuasgsu | 703 | ACUAGUGCAUGAAUAGAUUCUCU | 704 |
| AD-392928 | cuscuc(Chd)UfgAfUfUf auuuaucaca | 705 | usGfsugau(Agn)aauaauCfa Gfgagagsasa | 706 | UUCUCUCCUGAUUAUUUAUCACA | 707 |
| AD-392929 | cscsuga(Uhd)UfaUfUfUf aucacauagu | 708 | asCfsuaug(Tgn)gauaaaUfa Afucaggsasg | 709 | CUCCUGAUUAUUUAUCACAUAGC | 710 |
| AD-392930 | usasagu(Chd)CfuAfCfUf uuacauaugu | 711 | asCfsauau(Ggn)uaaaguAfg Gfacuuasasu | 712 | AUUAAGUCCUACUUUACAUAUGC | 713 |
| AD-392931 | asgsucc(Uhd)AfcUfUfUf acauaugcuu | 714 | asAfsgcau(Agn)uguaaaGfu Afggacusus a | 715 | UAAGUCCUACUUUACAUAUGCUU | 716 |
| AD-392932 | gsusccu(Ahd)CfuUTfAf cauaugcuuu | 717 | asAfsagca(Tgn)auguaaAfg Ufaggacsusu | 718 | AAGUCCUACUUUACAUAUGCUUU | 719 |
| AD-392933 | ususcuc(Uhd)UfgCfCfUf aaguauuccu | 720 | asGfsgaau(Agn)cuuaggCfa Afgagaasgsc | 721 | GCUUCUCUUGCCUAAGUAUUCCU | 722 |
| AD-392934 | cuscuu(Ghd)CfcUfAfAf guauuccuuu | 723 | asAfsagga(Agn)uacuuaGfg Cfaagagsasa | 724 | UUCUCUUGCCUAAGUAUUCCUUU | 725 |
| AD-392935 | usasuuc(Chd)UfuUfCfCf ugaucacuau | 726 | asUfsagug(Agn)ucaggaAfa Gfgaauascsu | 727 | AGUAUUCCUUUCCUGAUCACUAU | 728 |
| AD-392936 | ususucc(Uhd)GfaUfCfAf cuaugcauuu | 729 | asAfsaugc(Agn)uagugaUfc Afggaaasgsg | 730 | CCUUUCCUGAUCACUAUGCAUUU | 731 |
| AD-392937 | csascua(Uhd)GfcAfUfUf uuaaguuaa | 732 | usufsaacu(Tgn)uaaaauGfc Afuagugsasu | 733 | AUCACUAUGCAUUUUAAAGUUAA | 734 |
| AD-392938 | csusgca(Uhd)UfuUfAfCf uguacagauu | 735 | asAfsucug(Tgn)acaguaAfa Afugcagsusc | 736 | GACUGCAUUUUACUGUACAGAUU | 737 |

TABLE 2B-continued

Human APP Modified Sequences, No "L96" Linker

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392939 | ususcug(Chd)UfaUfAfUf uugugauaua | 738 | usAfsuauc(Agn)caaauaUfa Gfcagaasgsc | 739 | GCUUCUGCUAUAUUUGUGAUAUA | 740 |
| AD-392940 | uscsugc(Uhd)AfuAfUfUf ugugauauau | 741 | asUfsauau(Cgn)acaaauAfu Afgcagasasg | 742 | CUUCUGCUAUAUUUGUGAUAUAG | 743 |
| AD-392941 | ascsgua(Uhd)CfuUTfGf ggucuuugau | 744 | asUfscaaa(Ggn)acccaaAfg Afuacgusgsg | 745 | CCACGUAUCUUUGGGUCUUUGAU | 746 |
| AD-392942 | uscsuuu(Ghd)GfgUfCfUf uugauaaaga | 747 | uscfsuuua(Tgn)caaagaCfc Cfaaagasusa | 748 | UAUCUUUGGGUCUUUGAUAAAGA | 749 |
| AD-392943 | csusuug(Ghd)GfuCfUfUf ugauaaagaa | 750 | usufscuuu(Agn)uchaagAfc Cfcaaagsasu | 751 | AUCUUUGGGUCUUUGAUAAAGAA | 752 |
| AD-392944 | ususggg(Uhd)CfuUTfGf auaaagaaaa | 753 | usUfsuucu(Tgn)uaucaaAfg Afcccaasasg | 754 | CUUUGGGUCUUUGAUAAAGAAAA | 755 |
| AD-392945 | asgsaau(Chd)CfcUfGfUf ucauuguaau | 756 | asUfsuaca(Agn)ugaacaGfg Gfauucsusu | 757 | AAAGAAUCCCUGUUCAUUGUAAG | 758 |
| AD-392946 | gsasauc(Chd)CfuGfUfUf cauuguaagu | 759 | asCfsuuac(Agn)augaacAfg Gfgauucsusu | 760 | AAGAAUCCCUGUUCAUUGUAAGC | 761 |
| AD-392947 | gsusuca(Uhd)UfgUfAfAf gcacummau | 762 | asUfsaaaa(Ggn)ugcuuaCfa Afugaacsasg | 763 | CUGUUCAUUGUAAGCACUUUUAC | 764 |
| AD-392948 | ususaug(Ahd)CfaUfGfAf ucgcuuucua | 765 | usAfsgaaa(Ggn)cgaucaUfg Ufcauaasgsc | 766 | GCUUAUGACAUGAUCGCUUUCUA | 767 |
| AD-392949 | asusgac(Ahd)UfgAfUfCf gcuuucuaca | 768 | usGfsuaga(Agn)agcgauCfa Ufgucausasa | 769 | UUAUGACAUGAUCGCUUUCUACA | 770 |
| AD-392950 | csasuga(Uhd)CfgCfUfUf ucuacacugu | 771 | asCfsagug(Tgn)agaaagCfg Afucaugsusc | 772 | GACAUGAUCGCUUUCUACACUGU | 773 |
| AD-392951 | csusuuc(Uhd)AfcAfCfUf guauuacaua | 774 | usAfsugua(Agn)uacaguGfu Afgaaagscsg | 775 | CGCUUUCUACACUGUAUUACAUA | 776 |
| AD-392952 | gsasuuc(Ahd)AfuUfUfUf cuuuaaccau | 777 | asUfsgguu(Agn)aagaaaAfu Ufgaaucsusg | 778 | CAGAUUCAAUUUUCUUUAACCAG | 779 |
| AD-392953 | ususucu(Uhd)UfaAfCfCf agucugaagu | 780 | asCfsuuca(Ggn)acugguUfa Afagaaasasu | 781 | AUUUUCUUUAACCAGUCUGAAGU | 782 |
| AD-392954 | ususuaa(Ghd)AfuGfUfGf ucuucaauuu | 783 | asAfsauug(Agn)agacacUfu Cfuuaaasasg | 784 | CUUUUAAGAUGUGUCUUCAAUUU | 785 |
| AD-392955 | ususaag(Ahd)UfgUfGfUf cuucaauuug | 786 | csAfsaauu(Ggn)aagacaCfa Ufcuuaasasa | 787 | UUUUAAGAUGUGUCUUCAAUUUG | 788 |
| AD-392956 | asgsaug(Uhd)GfuCfUfUf caauuuguau | 789 | asUfsacaa(Agn)uugaagAfc Afcaucususa | 790 | UAAGAUGUGUCUUCAAUUUGUAU | 791 |
| AD-392957 | usgsucu(Uhd)CfaAfUfUf uguauaaaau | 792 | asufsuuua(Tgn)acaaauUfg Afagacascsa | 793 | UGUGUCUUCAAUUUGUAUAAAAU | 794 |
| AD-392958 | csusuca(Ahd)UfuUfGfUf auaaaauggu | 795 | asCfscauu(Tgn)uauacaAfa Ufugaagsasc | 796 | GUCUUCAAUUUGUAUAAAAUGGU | 797 |
| AD-392959 | asusggu(Ghd)UfuUfCfUf auguaaauaa | 798 | usUfsauuu(Agn)caugaaAfa Cfaccaususu | 799 | AAAUGGUGUUUCAUGUAAAUAA | 800 |
| AD-392960 | ususcuu(Uhd)UfaAfGfAf ugugucuuca | 801 | usGfsaaga(Cgn)acaucuUfa Afaagaasgsg | 802 | CCUUCUUUUAAGAUGUGUCUUCA | 803 |
| AD-392961 | usgsuau(Uhd)CfuAfUfCf ucucuuuaca | 804 | usGfsuaaa(Ggn)agagahAfg Afauacasusu | 805 | AAUGUAUUCUAUCUCUCUUUACA | 806 |
| AD-392962 | gsuscuc(Uhd)AfuAfCfUf acauuauaa | 807 | usUfsaaua(Agn)uguaguAfu Afgagacscsa | 808 | UGGUCUCUAUACUACAUUAUUAA | 809 |
| AD-392963 | uscsucu(Ahd)UfaCfUfAf cauuuuaau | 810 | asUfsuaau(Agn)auguagUfa Ufagagascsc | 811 | GGUCUCUAUACUACAUUAUUAAU | 812 |

TABLE 2B-continued

Human APP Modified Sequences, No "L96" Linker

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-392964 | csuscua(Uhd)AfcUfAfCf auuauuaauu | 813 | asAfsuuaa(Tgn)aauguaGfu Afuagagsasc | 814 | GUCUCUAUACUACAUUAUUAAUG | 815 |
| AD-392965 | csusuca(Ahd)UfuAfCfCf aagaauucuu | 816 | asAfsgaau(Tgn)cuugguAfa Ufugaagsasc | 817 | GUCUUCAAUUACCAAGAAUUCUC | 818 |
| AD-392966 | cscsaca(Chd)AfuCfAfGf uaauguauuu | 819 | asAfsauac(Agn)uuacugAfu Gfuguggsasu | 820 | AUCCACACAUCAGUAAUGUAUUC | 821 |
| AD-392967 | csusauc(Uhd)CfuCfUfUf uacauuuugu | 822 | asCfsaaaa(Tgn)guaaagAfg Afgauagsasa | 823 | UUCUAUCUCUCUUUACAUUUUGG | 824 |
| AD-392968 | gsgsucu(Chd)UfaUfAfCf uacauuauua | 825 | usAfsauaa(Tgn)guaguaUfa Gfagaccsasa | 826 | UUGGUCUCUAUACUACAUUAUUA | 827 |
| AD-392969 | uscsuau(Ahd)CfuAfCfAf uuauuaaugu | 828 | asCfsauua(Agn)uaauguAfg Ufauagasgsa | 829 | UCUCUAUACUACAUUAuuAAuGG | 830 |
| AD-392970 | gsgsucu(Uhd)CfaAfUfUf accaagaauu | 831 | asAfsuucu(Tgn)gguaauUfg Afagaccsasg | 832 | CUGGUCUUCAAUUACCAAGAAUU | 833 |
| AD-392971 | csasgga(Uhd)AfuGfAfAf guucaucauu | 834 | asAfsugau(Ggn)aacuucAfu Afuccugsasg | 835 | CuCAGGAUAUGAAGUUCAUCAUC | 836 |
| AD-392972 | ascsaca(Uhd)CfaGfUfAf auguauucua | 837 | usAfsgaau(Agn)cauuacUfg Afugugusgsg | 838 | CCACACAUCAGUAAUGUAUUCUA | 839 |
| AD-392973 | csusaua(Chd)UfaCfAfUf uauuaauggu | 840 | asCfscauu(Agn)auaaugUfa Gfuauagsasg | 841 | CUCUAUACUACAUUAUUAAUGGG | 842 |
| AD-392974 | cscscgu(Uhd)UfuAfUfGf auuuacucau | 843 | asUfsgagu(Agn)aaucauAfa Afacgggsusu | 844 | AACCCGUUUUAUGAUUUACUCAU | 845 |
| AD-392975 | ususcca(Uhd)GfaCfUfGf cauuuuacuu | 846 | asAfsguaa(Agn)augcagUfc Afuggaasasa | 847 | UUUUCCAUGACUGCAUUUUACUG | 848 |
| AD-392976 | uscsuuc(Ahd)AfuUfAfCf caagaauucu | 849 | asGfsaauu(Cgn)uugguaAfu Ufgaagascsc | 850 | GGUCUUCAAUUACCAAGAAUUCU | 851 |
| AD-392977 | csusgaa(Ghd)UfuUfUCfAf uuuaugauau | 852 | asUfsauca(Tgn)aaaugaAfa Cfuucagsasc | 853 | GUCUGAAGUUUCAUUUAUGAUAC | 854 |

TABLE 3

APP Unmodified Sequences, Human NM_000484 Targeting

| Duplex Name | Sense Sequence (5' to 3') | SEQ ID NO | Position in NM_000484 | Antisense Sequence (5' to 3') | SEQ ID NO | Position in NM_000484 |
|---|---|---|---|---|---|---|
| AD-392853 | GCGCCAUGUCCCAAAGUUUAU | 855 | 1228-1248 | AUAAACUUUGGGACAUGGCGCUG | 856 | 1226-1248 |
| AD-392857 | CUUGCCCGAGAUCCUGUUAAA | 857 | 1269-1289 | UUUAACAGGAUCUCGGGCAAGAG | 858 | 1267-1289 |
| AD-392851 | UUGCCCGAGAUCCUGUUAAAU | 859 | 1270-1290 | AUUUAACAGGAUCUCGGGCAAGA | 860 | 1268-1290 |
| AD-392811 | UGCCCGAGAUCCUGUUAAACU | 861 | 1271-1291 | AGUUUAACAGGAUCUCGGGCAAG | 862 | 1269-1291 |
| AD-392910 | GAUCCUGUUAAACUUCCUACA | 863 | 1278-1298 | UGUAGGAAGUUUAACAGGAUCUC | 864 | 1276-1298 |
| AD-392890 | AUCCUGUUAAACUUCCUACAA | 865 | 1279-1299 | UUGUAGGAAGUUUAACAGGAUCU | 866 | 1277-1299 |
| AD-392911 | CUGCUUCAGAAAGAGCAAAAU | 867 | 1893-1913 | AUUUUGCUCUUUCUGAAGCAGCU | 868 | 1891-1913 |
| AD-392912 | CAGAAAGAGCAAAACUAUUCA | 869 | 1899-1919 | UGAAUAGUUUUGCUCUUUCUGAA | 870 | 1897-1919 |
| AD-392778 | GAGCAAAACUAUUCAGAUGAU | 871 | 1905-1925 | AUCAUCTGAAUAGUUUUGCUCUU | 872 | 1903-1925 |
| AD-392727 | AAAACUAUUCAGAUGACGUCU | 873 | 1909-1929 | AGACGUCAUCUGAAUAGUUUUGC | 874 | 1907-1929 |
| AD-392728 | AAACUAUUCAGAUGACGUCUU | 875 | 1910-1930 | AAGACGTCAUCUGAAUAGUUUUG | 876 | 1908-1930 |

TABLE 3-continued

APP Unmodified Sequences, Human NM_000484 Targeting

| Duplex Name | Sense Sequence (5' to 3') | SEQ ID NO | Position in NM_000484 | Antisense Sequence (5' to 3') | SEQ ID NO | Position in NM_000484 |
|---|---|---|---|---|---|---|
| AD-392891 | ACUAUUCAGAUGACGUCUUGU | 877 | 1912-1932 | ACAAGACGUCAUCUGAAUAGUUU | 878 | 1910-1932 |
| AD-392822 | UUCAGAUGACGUCUUGGCCAA | 879 | 1916-1936 | UUGGCCAAGACGUCAUCUGAAUA | 880 | 1914-1936 |
| AD-392749 | GGCCAACAUGAUUAGUGAACU | 881 | 1931-1951 | AGUUCACUAAUCAUGUUGGCCAA | 882 | 1929-1951 |
| AD-392794 | CCAACAUGAUUAGUGAACCAA | 883 | 1933-1953 | UUGGUUCACUAAUCAUGUUGGCC | 884 | 1931-1953 |
| AD-392795 | AUGAUUAGUGAACCAAGGAUU | 885 | 1938-1958 | AAUCCUTGGUUCACUAAUCAUGU | 886 | 1936-1958 |
| AD-392812 | AUUAGUGAACCAAGGAUCAGU | 887 | 1941-1961 | ACUGAUCCUUGGUUCACUAAUCA | 888 | 1939-1961 |
| AD-392796 | UUAGUGAACCAAGGAUCAGUU | 889 | 1942-1962 | AACUGAUCCUUGGUUCACUAAUC | 890 | 1940-1962 |
| AD-392779 | AGUGAACCAAGGAUCAGUUAU | 891 | 1944-1964 | AUAACUGAUCCUUGGUUCACUAA | 892 | 1942-1964 |
| AD-392780 | UGAACCAAGGAUCAGUUACGU | 893 | 1946-1966 | ACGUAACUGAUCCUUGGUUCACU | 894 | 1944-1966 |
| AD-392813 | GAACCAAGGAUCAGUUACGGA | 895 | 1947-1967 | UCCGUAACUGAUCCUUGGUUCAC | 896 | 1945-1967 |
| AD-392797 | AACCAAGGAUCAGUUACGAA | 897 | 1948-1968 | UUCCGUAACUGAUCCUUGGUUCA | 898 | 1946-1968 |
| AD-392761 | CAAGGAUCAGUUACGGAAACU | 899 | 1951-1971 | AGUUUCCGUAACUGAUCCUUGGU | 900 | 1949-1971 |
| AD-392814 | AAGGAUCAGUUACGGAAACGA | 901 | 1952-1972 | UCGUUUCCGUAACUGAUCCUUGG | 902 | 1950-1972 |
| AD-392742 | GGAUCAGUUACGGAAACGAUU | 903 | 1954-1974 | AAUCGUUCCGUAACUGAUCCUU | 904 | 1952-1974 |
| AD-392750 | GAUCAGUUACGGAAACGAUGU | 905 | 1955-1975 | ACAUCGUUCCGUAACUGAUCCU | 906 | 1953-1975 |
| AD-392823 | AUCAGUUACGGAAACGAUGCU | 907 | 1956-1976 | AGCAUCGUUUCCGUAACUGAUCC | 908 | 1954-1976 |
| AD-392789 | UCAGUUACGGAAACGAUGCUU | 909 | 1957-1977 | AAGCAUCGUUUCCGUAACUGAUC | 910 | 1955-1977 |
| AD-392781 | CAGUUACGGAAACGAUGCUCU | 911 | 1958-1978 | AGAGCATCGUUUCCGUAACUGAU | 912 | 1956-1978 |
| AD-392798 | GUUACGGAAACGAUGCUCUCA | 913 | 1960-1980 | UGAGAGCAUCGUUUCCGUAACUG | 914 | 1958-1980 |
| AD-392751 | UACGGAAACGAUGCUCUCAUU | 915 | 1962-1982 | AAUGAGAGCAUCGUUUCCGUAAC | 916 | 1960-1982 |
| AD-392858 | CUCAUGCCAUCUUUGACCGAA | 917 | 1977-1997 | UUCGGUCAAAGAUGGCAUGAGAG | 918 | 1975-1997 |
| AD-392844 | UCAUGCCAUCUUUGACCGAAA | 919 | 1978-1998 | UUUCGGTCAAAGAUGGCAUGAGA | 920 | 1976-1998 |
| AD-392842 | CAUGCCAUCUUUGACCGAAAU | 921 | 1979-1999 | AUUUCGGUCAAAGAUGGCAUGAG | 922 | 1977-1999 |
| AD-392848 | AUGCCAUCUUUGACCGAAACU | 923 | 1980-2000 | AGUUUCGGUCAAAGAUGGCAUGA | 924 | 1978-2000 |
| AD-392838 | GCCAUCUUUGACCGAAACGAA | 925 | 1982-2002 | UUCGUUUCGGUCAAAGAUGGCAU | 926 | 1980-2002 |
| AD-392839 | CCAUCUUUGACCGAAACGAAA | 927 | 1983-2003 | UUUCGUUCGGUCAAAGAUGGCA | 928 | 1981-2003 |
| AD-392734 | UCUUUGACCGAAACGAAAACU | 929 | 1986-2006 | AGUUUUCGUUUCGGUCAAAGAUG | 930 | 1984-2006 |
| AD-392790 | CUUCCCGUGAAUGGAGAGUUU | 931 | 2019-2039 | AAACUCUCCAUUCACGGGAAGGA | 932 | 2017-2039 |
| AD-392815 | CAACACAGAAAACGAAGUUGA | 933 | 2093-2113 | UCAACUUCGUUUUCUGUGUUGGC | 934 | 2091-2113 |
| AD-392762 | AGGUUCUGGGUUGACAAAUAU | 935 | 2162-2182 | AUAUUUGUCAACCCAGAACCUGG | 936 | 2160-2182 |
| AD-392735 | GUUCUGGGUUGACAAAUAUCA | 937 | 2164-2184 | UGAUAUUGUCAACCCAGAACCU | 938 | 2162-2184 |
| AD-392743 | CUGGGUUGACAAAUAUCAAGA | 939 | 2167-2187 | UCUUGAUAUUUGUCAACCCAGAA | 940 | 2165-2187 |
| AD-392736 | UGGGUUGACAAAUAUCAAGAU | 941 | 2168-2188 | AUCUUGAUAUUUGUCAACCCAGA | 942 | 2166-2188 |
| AD-392824 | UGGAUGCAGAAUUCCGACAUU | 943 | 2212-2232 | AAUGUCGGAAUUCUGCAUCCAUC | 944 | 2210-2232 |
| AD-392799 | GAUGCAGAAUUCCGACAUGAU | 945 | 2214-2234 | AUCAUGTCGGAAUUCUGCAUCCA | 946 | 2212-2234 |
| AD-392971 | CAGGAUAUGAAGUUCAUCAUU | 947 | 2236-2256 | AAUGAUGAACUUCAUAUCCUGAG | 948 | 2234-2256 |
| AD-392913 | UAUGAAGUUCAUCAUCAAAAA | 949 | 2241-2261 | UUUUUGAUGAUGAACUUCAUAUC | 950 | 2239-2261 |

TABLE 3-continued

APP Unmodified Sequences, Human NM_000484 Targeting

| Duplex Name | Sense Sequence (5' to 3') | SEQ ID NO | Position in NM_000484 | Antisense Sequence (5' to 3') | SEQ ID NO | Position in NM_000484 |
|---|---|---|---|---|---|---|
| AD-392892 | GUUCAUCAUCAAAAAUUGGUU | 951 | 2247-2267 | AACCAAUUUUUGAUGAUGAACUU | 952 | 2245-2267 |
| AD-392914 | CAUCAUCAAAAAUUGGUGUUU | 953 | 2250-2270 | AAACACCAAUUUUUGAUGAUGAA | 954 | 2248-2270 |
| AD-392860 | CAUCAAAAAUUGGUGUUCUUU | 955 | 2253-2273 | AAAGAACACCAAUUUUUGAUGAU | 956 | 2251-2273 |
| AD-392875 | AUCAAAAAUUGGUGUUCUUUG | 957 | 2254-2274 | CAAAGAACACCAAUUUUUGAUGA | 958 | 2252-2274 |
| AD-392915 | UCAAAAAUUGGUGUUCUUUGU | 959 | 2255-2275 | ACAAAGAACACCAAUUUUUGAUG | 960 | 2253-2275 |
| AD-392782 | AGAAGAUGUGGGUUCAAACAA | 961 | 2276-2296 | UUGUUUGAACCCACAUCUUCUGC | 962 | 2274-2296 |
| AD-392763 | AAGAUGUGGGUUCAAACAAAU | 963 | 2278-2298 | AUUUGUUGAACCCACAUCUUCU | 964 | 2276-2298 |
| AD-392816 | UGGGUUCAAACAAAGGUGCAA | 965 | 2284-2304 | UUGCACCUUUGUUUGAACCCACA | 966 | 2282-2304 |
| AD-392704 | GGUUCAAACAAAGGUGCAAUU | 967 | 2286-2306 | AAUUGCACCUUUGUUUGAACCCA | 968 | 2284-2306 |
| AD-392854 | GUCAUAGCGACAGUGAUCGUU | 969 | 2331-2351 | AACGAUCACUGUCGCUAUGACAA | 970 | 2329-2351 |
| AD-392856 | AUAGCGACAGUGAUCGUCAUU | 971 | 2334-2354 | AAUGACGAUCACUGUCGCUAUGA | 972 | 2332-2354 |
| AD-392817 | CAGUGAUCGUCAUCACCUUGU | 973 | 2341-2361 | ACAAGGTGAUGACGAUCACUGUC | 974 | 2339-2361 |
| AD-392764 | CUGAAGAAGAAACAGUACACA | 975 | 2367-2387 | UGUGUACUGUUUCUUCUUCAGCA | 976 | 2365-2387 |
| AD-392845 | CAGUACACAUCCAUUCAUCAU | 977 | 2379-2399 | AUGAUGAAUGGAUGUGUACUGUU | 978 | 2377-2399 |
| AD-392825 | GUCCAAGAUGCAGCAGAACGU | 979 | 2447-2467 | ACGUUCUGCUGCAUCUUGGACAG | 980 | 2445-2467 |
| AD-392849 | GAACGGCUACGAAAAUCCAAU | 981 | 2462-2482 | AUUGGAUUUCGUAGCCGUUCUG | 982 | 2460-2482 |
| AD-392846 | AACGGCUACGAAAAUCCAACU | 983 | 2463-2483 | AGUUGGAUUUCGUAGCCGUUCU | 984 | 2461-2483 |
| AD-392859 | ACGGCUACGAAAAUCCAACCU | 985 | 2464-2484 | AGGUUGGAUUUCGUAGCCGUUC | 986 | 2462-2484 |
| AD-392843 | GGCUACGAAAAUCCAACCUAU | 987 | 2466-2486 | AUAGGUUGGAUUUCGUAGCCGU | 988 | 2464-2486 |
| AD-392855 | GCUACGAAAAUCCAACCUACA | 989 | 2467-2487 | UGUAGGUGGAUUUCGUAGCCG | 990 | 2465-2487 |
| AD-392840 | CUACGAAAAUCCAACCUACAA | 991 | 2468-2488 | UUGUAGGUUGGAUUUCGUAGCC | 992 | 2466-2488 |
| AD-392835 | UACGAAAAUCCAACCUACAAU | 993 | 2469-2489 | AUUGUAGGUUGGAUUUCGUAGC | 994 | 2467-2489 |
| AD-392729 | ACGAAAAUCCAACCUACAAGU | 995 | 2470-2490 | ACUUGUAGGUUGGAUUUCGUAG | 996 | 2468-2490 |
| AD-392916 | AAAAUCCAACCUACAAGUUCU | 997 | 2473-2493 | AGAACUGUAGGUUGGAUUUCG | 998 | 2471-2493 |
| AD-392876 | AAAUCCAACCUACAAGUUCUU | 999 | 2474-2494 | AAGAACUGUAGGUUGGAUUUC | 1000 | 2472-2494 |
| AD-392861 | AUCCAACCUACAAGUUCUUUG | 1001 | 2476-2496 | CAAAGAACUUGUAGGUUGGAUUU | 1002 | 2474-2496 |
| AD-392863 | UCCAACCUACAAGUUCUUUGA | 1003 | 2477-2497 | UCAAAGAACUUGUAGGUUGGAUU | 1004 | 2475-2497 |
| AD-392917 | CCAACCUACAAGUUCUUUGAU | 1005 | 2478-2498 | AUCAAAGAACUUGUAGGUUGGAU | 1006 | 2476-2498 |
| AD-392783 | CCUCUGAAGUUGGACAGCAAA | 1007 | 2530-2550 | UUUGCUGUCCAACUUCAGAGGCU | 1008 | 2528-2550 |
| AD-392765 | AAGUUGGACAGCAAAACCAUU | 1009 | 2536-2556 | AAUGGUUUGCUGUCCAACUUCA | 1010 | 2534-2556 |
| AD-392791 | AGUUGGACAGCAAAACCAUUU | 1011 | 2537-2557 | AAAUGGUUUUGCUGUCCAACUUC | 1012 | 2535-2557 |
| AD-392800 | UUGGACAGCAAAACCAUUGCU | 1013 | 2539-2559 | AGCAAUGGUUUUGCUGUCCAACU | 1014 | 2537-2559 |
| AD-392711 | GCAAAACCAUUGCUUCACUAU | 1015 | 2546-2566 | AUAGUGAAGCAAUGGUUUUGCUG | 1016 | 2544-2566 |
| AD-392801 | AAACCAUUGCUUCACUACCCA | 1017 | 2549-2569 | UGGGUAGUGAAGCAAUGGUUUUG | 1018 | 2547-2569 |
| AD-392826 | UACCCAUCGGUGUCCAUUUAU | 1019 | 2564-2584 | AUAAAUGGACACCGAUGGGUAGU | 1020 | 2562-2584 |
| AD-392818 | ACCCAUCGGUGUCCAUUUAUA | 1021 | 2565-2585 | UAUAAATGGACACCGAUGGGUAG | 1022 | 2563-2585 |
| AD-392792 | CCCAUCGGUGUCCAUUUAUAU | 1023 | 2566-2586 | AUAUAAAUGGACACCGAUGGGUA | 1024 | 2564-2586 |

TABLE 3-continued

APP Unmodified Sequences, Human NM_000484 Targeting

| Duplex Name | Sense Sequence (5' to 3') | SEQ ID NO | Position in NM_000484 | Antisense Sequence (5' to 3') | SEQ ID NO | Position in NM_000484 |
|---|---|---|---|---|---|---|
| AD-392802 | CCAUCGGUGUCCAUUUAUAGA | 1025 | 2567-2587 | UCUAUAAAUGGACACCGAUGGGU | 1026 | 2565-2587 |
| AD-392766 | AUCGGUGUCCAUUUAUAGAAU | 1027 | 2569-2589 | AUUCUAUAAAUGGACACCGAUGG | 1028 | 2567-2589 |
| AD-392767 | UCGGUGUCCAUUUAUAGAAUA | 1029 | 2570-2590 | UAUUCUAUAAAUGGACACCGAUG | 1030 | 2568-2590 |
| AD-392834 | ACCCGUUUUAUGAUUUACUCA | 1031 | 2607-2627 | UGAGUAAAUCAUAAAACGGGUUU | 1032 | 2605-2627 |
| AD-392974 | CCCGUUUUAUGAUUUACUCAU | 1033 | 2608-2628 | AUGAGUAAAUCAUAAAACGGGUU | 1034 | 2606-2628 |
| AD-392784 | UUAUGAUUUACUCAUUAUCGU | 1035 | 2614-2634 | ACGAUAAUGAGUAAAUCAUAAAA | 1036 | 2612-2634 |
| AD-392744 | AUGAUUUACUCAUUAUCGCCU | 1037 | 2616-2636 | AGGCGAUAAUGAGUAAAUCAUAA | 1038 | 2614-2636 |
| AD-392752 | UGAUUUACUCAUUAUCGCCUU | 1039 | 2617-2637 | AAGGCGAUAAUGAGUAAAUCAUA | 1040 | 2615-2637 |
| AD-392737 | GAUUUACUCAUUAUCGCCUUU | 1041 | 2618-2638 | AAAGGCGAUAAUGAGUAAAUCAU | 1042 | 2616-2638 |
| AD-392712 | AUUUACUCAUUAUCGCCUUUU | 1043 | 2619-2639 | AAAAGGCGAUAAUGAGUAAAUCA | 1044 | 2617-2639 |
| AD-392705 | UUUACUCAUUAUCGCCUUUUG | 1045 | 2620-2640 | CAAAAGGCGAUAAUGAGUAAAUC | 1046 | 2618-2640 |
| AD-392713 | UACUCAUUAUCGCCUUUUGAU | 1047 | 2622-2642 | AUCAAAAGGCGAUAAUGAGUAAA | 1048 | 2620-2642 |
| AD-392918 | ACUCAUUAUCGCCUUUUGACA | 1049 | 2623-2643 | UGUCAAAAGGCGAUAAUGAGUAA | 1050 | 2621-2643 |
| AD-392919 | CUCAUUAUCGCCUUUUGACAU | 1051 | 2624-2644 | AUGUCAAAAGGCGAUAAUGAGUA | 1052 | 2622-2644 |
| AD-392803 | UUAUCGCCUUUUGACAGCUGU | 1053 | 2628-2648 | ACAGCUGUCAAAAGGCGAUAAUG | 1054 | 2626-2648 |
| AD-392804 | AUCGCCUUUUGACAGCUGUGU | 1055 | 2630-2650 | ACACAGCUGUCAAAAGGCGAUAA | 1056 | 2628-2650 |
| AD-392827 | UUUUGACAGCUGUGCUGUAAU | 1057 | 2636-2656 | AUUACAGCACAGCUGUCAAAAGG | 1058 | 2634-2656 |
| AD-392828 | UUGACAGCUGUGCUGUAACAU | 1059 | 2638-2658 | AUGUUACAGCACAGCUGUCAAAA | 1060 | 2636-2658 |
| AD-392785 | ACAGCUGUGCUGUAACACAAU | 1061 | 2641-2661 | AUUGUGUUACAGCACAGCUGUCA | 1062 | 2639-2661 |
| AD-392829 | AGCUGUGCUGUAACACAAGUA | 1063 | 2643-2663 | UACUUGUGUUACAGCACAGCUGU | 1064 | 2641-2663 |
| AD-392920 | UGUGCUGUAACACAAGUAGAU | 1065 | 2646-2666 | AUCUACUUGUGUUACAGCACAGC | 1066 | 2644-2666 |
| AD-392921 | GUGCUGUAACACAAGUAGAUU | 1067 | 2647-2667 | AAUCUACUUGUGUUACAGCACAG | 1068 | 2645-2667 |
| AD-392768 | GCUGUAACACAAGUAGAUGCU | 1069 | 2649-2669 | AGCAUCUACUUGUGUUACAGCAC | 1070 | 2647-2669 |
| AD-392805 | ACACAAGUAGAUGCCUGAACU | 1071 | 2655-2675 | AGUUCAGGCAUCUACUUGUGUUA | 1072 | 2653-2675 |
| AD-392769 | AAGUAGAUGCCUGAACUUGAA | 1073 | 2659-2679 | UUCAAGUUCAGGCAUCUACUUGU | 1074 | 2657-2679 |
| AD-392753 | GUAGAUGCCUGAACUUGAAUU | 1075 | 2661-2681 | AAUUCAAGUUCAGGCAUCUACUU | 1076 | 2659-2681 |
| AD-392714 | UGCCUGAACUUGAAUUAAUCU | 1077 | 2666-2686 | AGAUUAAUUCAAGUUCAGGCAUC | 1078 | 2664-2686 |
| AD-392703 | CCUGAACUUGAAUUAAUCCAU | 1079 | 2668-2688 | AUGGAUUAAUUCAAGUUCAGGCA | 1080 | 2666-2688 |
| AD-392715 | CUGAACUUGAAUUAAUCCACA | 1081 | 2669-2689 | UGUGGAUUAAUUCAAGUUCAGGC | 1082 | 2667-2689 |
| AD-392841 | AUCCACACAUCAGUAAUGUAU | 1083 | 2683-2703 | AUACAUUACUGAUGUGUGGAUUA | 1084 | 2681-2703 |
| AD-392836 | UCCACACAUCAGUAAUGUAUU | 1085 | 2684-2704 | AAUACAUUACUGAUGUGUGGAUU | 1086 | 2682-2704 |
| AD-392966 | CCACACAUCAGUAAUGUAUUU | 1087 | 2685-2705 | AAAUACAUUACUGAUGUGUGGAU | 1088 | 2683-2705 |
| AD-392832 | CACACAUCAGUAAUGUAUUCU | 1089 | 2686-2706 | AGAAUACAUUACUGAUGUGUGGA | 1090 | 2684-2706 |
| AD-392972 | ACACAUCAGUAAUGUAUUCUA | 1091 | 2687-2707 | UAGAAUACAUUACUGAUGUGUGG | 1092 | 2685-2707 |
| AD-392961 | UGUAUUCUAUCUCUCUUUACA | 1093 | 2699-2719 | UGUAAAGAGAGAUAGAAUACAUU | 1094 | 2697-2719 |
| AD-392967 | CUAUCUCUCUUUACAUUUUGU | 1095 | 2705-2725 | ACAAAAUGUAAAGAGAGAUAGAA | 1096 | 2703-2725 |
| AD-392893 | UAUCUCUCUUUACAUUUUGGU | 1097 | 2706-2726 | ACCAAAAUGUAAAGAGAGAUAGA | 1098 | 2704-2726 |

TABLE 3-continued

APP Unmodified Sequences, Human NM_000484 Targeting

| Duplex Name | Sense Sequence (5' to 3') | SEQ ID NO | Position in NM_000484 | Antisense Sequence (5' to 3') | SEQ ID NO | Position in NM_000484 |
|---|---|---|---|---|---|---|
| AD-392894 | AUCUCUCUUUACAUUUUGGUU | 1099 | 2707-2727 | AACCAAAAUGUAAAGAGAGAUAG | 1100 | 2705-2727 |
| AD-392864 | UCUCUCUUUACAUUUUGGUCU | 1101 | 2708-2728 | AGACCAAAAUGUAAAGAGAGAUA | 1102 | 2706-2728 |
| AD-392865 | CUCUCUUUACAUUUUGGUCUU | 1103 | 2709-2729 | AAGACCAAAAUGUAAAGAGAGAU | 1104 | 2707-2729 |
| AD-392922 | UCUUUACAUUUUGGUCUCUAU | 1105 | 2712-2732 | AUAGAGACCAAAAUGUAAAGAGA | 1106 | 2710-2732 |
| AD-392833 | UGGUCUCUAUACUACAUUAUU | 1107 | 2723-2743 | AAUAAUGUAGUAUAGAGACCAA | 1108 | 2721-2743 |
| AD-392968 | GGUCUCUAUACUACAUUAUUA | 1109 | 2724-2744 | UAAUAAUGUAGUAUAGAGACCAA | 1110 | 2722-2744 |
| AD-392962 | GUCUCUAUACUACAUUAUUAA | 1111 | 2725-2745 | UUAAUAAUGUAGUAUAGAGACCA | 1112 | 2723-2745 |
| AD-392963 | UCUCUAUACUACAUUAUUAAU | 1113 | 2726-2746 | AUUAAUAAUGUAGUAUAGAGACC | 1114 | 2724-2746 |
| AD-392964 | CUCUAUACUACAUUAUUAAUU | 1115 | 2727-2747 | AAUUAAUAAUGUAGUAUAGAGAC | 1116 | 2725-2747 |
| AD-392969 | UCUAUACUACAUUAUUAAUGU | 1117 | 2728-2748 | ACAUUAAUAAUGUAGUAUAGAGA | 1118 | 2726-2748 |
| AD-392973 | CUAUACUACAUUAUUAAUGGU | 1119 | 2729-2749 | ACCAUUAAUAAUGUAGUAUAGAG | 1120 | 2727-2749 |
| AD-392923 | AUGGGUUUUGUGUACUGUAAA | 1121 | 2745-2765 | UUUACAGUACACAAAACCCAUUA | 1122 | 2743-2765 |
| AD-392866 | UUUGUGUACUGUAAAGAAUUU | 1123 | 2751-2771 | AAAUUCUUUACAGUACACAAAAC | 1124 | 2749-2771 |
| AD-392924 | UUGUGUACUGUAAAGAAUUUA | 1125 | 2752-2772 | UAAAUUCUUUACAGUACACAAAA | 1126 | 2750-2772 |
| AD-392895 | UGUGUACUGUAAAGAAUUUAU | 1127 | 2753-2773 | AUAAAUCUUUACAGUACACAAA | 1128 | 2751-2773 |
| AD-392867 | GUGUACUGUAAAGAAUUUAGU | 1129 | 2754-2774 | ACUAAAUCUUUACAGUACACAA | 1130 | 2752-2774 |
| AD-392877 | GUACUGUAAAGAAUUUAGCUU | 1131 | 2756-2776 | AAGCUAAAUUCUUUACAGUACAC | 1132 | 2754-2776 |
| AD-392707 | AUUUAGCUGUAUCAAACUAGU | 1133 | 2768-2788 | ACUAGUUGAUACAGCUAAAUUC | 1134 | 2766-2788 |
| AD-392716 | UUUAGCUGUAUCAAACUAGUU | 1135 | 2769-2789 | AACUAGUUGAUACAGCUAAAUU | 1136 | 2767-2789 |
| AD-392925 | GCUGUAUCAAACUAGUGCAUU | 1137 | 2773-2793 | AAUGCACUAGUUUGAUACAGCUA | 1138 | 2771-2793 |
| AD-392926 | CUAGUGCAUGAAUAGAUUCUU | 1139 | 2784-2804 | AAGAAUCUAUUCAUGCACUAGUU | 1140 | 2782-2804 |
| AD-392927 | UAGUGCAUGAAUAGAUUCUCU | 1141 | 2785-2805 | AGAGAAUCUAUUCAUGCACUAGU | 1142 | 2783-2805 |
| AD-392717 | GAAUAGAUUCUCUCCUGAUUA | 1143 | 2793-2813 | UAAUCAGGAGAGAAUCUAUUCAU | 1144 | 2791-2813 |
| AD-392928 | CUCUCCUGAUUAUUUAUCACA | 1145 | 2802-2822 | UGUGAUAAAUAAUCAGGAGAGAA | 1146 | 2800-2822 |
| AD-392700 | UCUCCUGAUUAUUUAUCACAU | 1147 | 2803-2823 | AUGUGAUAAAUAAUCAGGAGAGA | 1148 | 2801-2823 |
| AD-392878 | CUCCUGAUUAUUUAUCACAUA | 1149 | 2804-2824 | UAUGUGAUAAAUAAUCAGGAGAG | 1150 | 2802-2824 |
| AD-392718 | UCCUGAUUAUUUAUCACAUAU | 1151 | 2805-2825 | AUAUGUGAUAAAUAAUCAGGAGA | 1152 | 2803-2825 |
| AD-392929 | CCUGAUUAUUUAUCACAUAGU | 1153 | 2806-2826 | ACUAUGUGAUAAAUAAUCAGGAG | 1154 | 2804-2826 |
| AD-392879 | GCCAGUUGUAUAUUAUUCUUU | 1155 | 2833-2853 | AAAGAAUAAUAUACAACUGGCUA | 1156 | 2831-2853 |
| AD-392754 | UUGUAUAUUAUUCUUGUGGUU | 1157 | 2838-2858 | AACCACAAGAAUAAUAUACAACU | 1158 | 2836-2858 |
| AD-392819 | UCUUGUGGUUUGUGACCCAAU | 1159 | 2849-2869 | AUUGGGUCACAAACCACAAGAAU | 1160 | 2847-2869 |
| AD-392745 | CUUGUGGUUUGUGACCCAAUU | 1161 | 2850-2870 | AAUUGGGUCACAAACCACAAGAA | 1162 | 2848-2870 |
| AD-392770 | UUGUGGUUUGUGACCCAAUUA | 1163 | 2851-2871 | UAAUUGGGUCACAAACCACAAGA | 1164 | 2849-2871 |
| AD-392806 | UGUGGUUUGUGACCCAAUUAA | 1165 | 2852-2872 | UUAAUUGGGUCACAAACCACAAG | 1166 | 2850-2872 |
| AD-392771 | GUUUGUGACCCAAUUAAGUCU | 1167 | 2856-2876 | AGACUUAAUUGGGUCACAAACCA | 1168 | 2854-2876 |
| AD-392820 | UUUGUGACCCAAUUAAGUCCU | 1169 | 2857-2877 | AGGACUUAAUUGGGUCACAAACC | 1170 | 2855-2877 |
| AD-392821 | UUGUGACCCAAUUAAGUCCUA | 1171 | 2858-2878 | UAGGACUUAAUUGGGUCACAAAC | 1172 | 2856-2878 |

TABLE 3-continued

APP Unmodified Sequences, Human NM_000484 Targeting

| Duplex Name | Sense Sequence (5' to 3') | SEQ ID NO | Position in NM_000484 | Antisense Sequence (5' to 3') | SEQ ID NO | Position in NM_000484 |
|---|---|---|---|---|---|---|
| AD-392786 | UGUGACCCAAUUAAGUCCUAU | 1173 | 2859-2879 | AUAGGACUUAAUUGGGUCACAAA | 1174 | 2857-2879 |
| AD-392772 | GUGACCCAAUUAAGUCCUACU | 1175 | 2860-2880 | AGUAGGACUUAAUUGGGUCACAA | 1176 | 2858-2880 |
| AD-392699 | GACCCAAUUAAGUCCUACUUU | 1177 | 2862-2882 | AAAGUAGGACUUAAUUGGGUCAC | 1178 | 2860-2882 |
| AD-392868 | ACCCAAUUAAGUCCUACUUUA | 1179 | 2863-2883 | UAAAGUAGGACUUAAUUGGGUCA | 1180 | 2861-2883 |
| AD-392719 | CCCAAUUAAGUCCUACUUUAU | 1181 | 2864-2884 | AUAAAGTAGGACUUAAUUGGGUC | 1182 | 2862-2884 |
| AD-392880 | AAUUAAGUCCUACUUUACAUA | 1183 | 2867-2887 | UAUGUAAAGUAGGACUUAAUUGG | 1184 | 2865-2887 |
| AD-392930 | UAAGUCCUACUUUACAUAUGU | 1185 | 2870-2890 | ACAUAUGUAAAGUAGGACUUAAU | 1186 | 2868-2890 |
| AD-392931 | AGUCCUACUUUACAUAUGCUU | 1187 | 2872-2892 | AAGCAUAUGUAAAGUAGGACUUA | 1188 | 2870-2892 |
| AD-392932 | GUCCUACUUUACAUAUGCUUU | 1189 | 2873-2893 | AAAGCATAUGUAAAGUAGGACUU | 1190 | 2871-2893 |
| AD-392869 | UCCUACUUUACAUAUGCUUUA | 1191 | 2874-2894 | UAAAGCAUAUGUAAAGUAGGACU | 1192 | 2872-2894 |
| AD-392870 | CCUACUUUACAUAUGCUUUAA | 1193 | 2875-2895 | UUAAAGCAUAUGUAAAGUAGGAC | 1194 | 2873-2895 |
| AD-392896 | CUACUUUACAUAUGCUUUAAU | 1195 | 2876-2896 | AUUAAAGCAUAUGUAAAGUAGGA | 1196 | 2874-2896 |
| AD-392787 | UACAUAUGCUUUAAGAAUCGA | 1197 | 2882-2902 | UCGAUUCUUAAAGCAUAUGUAAA | 1198 | 2880-2902 |
| AD-392720 | CAUAUGCUUUAAGAAUCGAUU | 1199 | 2884-2904 | AAUCGAUUCUUAAAGCAUAUGUA | 1200 | 2882-2904 |
| AD-392746 | AUAUGCUUUAAGAAUCGAUGU | 1201 | 2885-2905 | ACAUCGAUUCUUAAAGCAUAUGU | 1202 | 2883-2905 |
| AD-392773 | UAUGCUUUAAGAAUCGAUGGU | 1203 | 2886-2906 | ACCAUCGAUUCUUAAAGCAUAUG | 1204 | 2884-2906 |
| AD-392807 | GGGAUGCUUCAUGUGAACGUU | 1205 | 2906-2926 | AACGUUCACAUGAAGCAUCCCCC | 1206 | 2904-2926 |
| AD-392730 | UGCUUCUCUUGCCUAAGUAUU | 1207 | 2937-2957 | AAUACUAGGCAAGAGAAGCAGC | 1208 | 2935-2957 |
| AD-392721 | CUUCUCUUGCCUAAGUAUUCU | 1209 | 2939-2959 | AGAAUACUUAGGCAAGAGAAGCA | 1210 | 2937-2959 |
| AD-392933 | UUCUCUUGCCUAAGUAUUCCU | 1211 | 2940-2960 | AGGAAUACUUAGGCAAGAGAAGC | 1212 | 2938-2960 |
| AD-392934 | CUCUUGCCUAAGUAUUCCUUU | 1213 | 2942-2962 | AAAGGAAUACUUAGGCAAGAGAA | 1214 | 2940-2962 |
| AD-392881 | CUUGCCUAAGUAUUCCUUUCU | 1215 | 2944-2964 | AGAAAGGAAUACUUAGGCAAGAG | 1216 | 2942-2964 |
| AD-392897 | UGCCUAAGUAUUCCUUUCCUU | 1217 | 2946-2966 | AAGGAAAGGAAUACUUAGGCAAG | 1218 | 2944-2966 |
| AD-392898 | AAGUAUUCCUUUCCUGAUCAU | 1219 | 2951-2971 | AUGAUCAGGAAAGGAAUACUUAG | 1220 | 2949-2971 |
| AD-392708 | AGUAUUCCUUUCCUGAUCACU | 1221 | 2952-2972 | AGUGAUCAGGAAAGGAAUACUUA | 1222 | 2950-2972 |
| AD-392899 | GUAUUCCUUUCCUGAUCACUA | 1223 | 2953-2973 | UAGUGAUCAGGAAAGGAAUACUU | 1224 | 2951-2973 |
| AD-392935 | UAUUCCUUUCCUGAUCACUAU | 1225 | 2954-2974 | AUAGUGAUCAGGAAAGGAAUACU | 1226 | 2952-2974 |
| AD-392882 | AUUCCUUUCCUGAUCACUAUU | 1227 | 2955-2975 | AAUAGUGAUCAGGAAAGGAAUAC | 1228 | 2953-2975 |
| AD-392738 | UCCUUUCCUGAUCACUAUGCA | 1229 | 2957-2977 | UGCAUAGUGAUCAGGAAAGGAAU | 1230 | 2955-2977 |
| AD-392739 | CUUUCCUGAUCACUAUGCAUU | 1231 | 2959-2979 | AAUGCAUAGUGAUCAGGAAAGGA | 1232 | 2957-2979 |
| AD-392936 | UUUCCUGAUCACUAUGCAUUU | 1233 | 2960-2980 | AAAUGCAUAGUGAUCAGGAAAGG | 1234 | 2958-2980 |
| AD-392900 | UUCCUGAUCACUAUGCAUUUU | 1235 | 2961-2981 | AAAAUGCAUAGUGAUCAGGAAAG | 1236 | 2959-2981 |
| AD-392901 | CUGAUCACUAUGCAUUUUAAA | 1237 | 2964-2984 | UUUAAAAUGCAUAGUGAUCAGGA | 1238 | 2962-2984 |
| AD-392937 | CACUAUGCAUUUUAAAGUUAA | 1239 | 2969-2989 | UUAACUUAAAAUGCAUAGUGAU | 1240 | 2967-2989 |
| AD-392883 | ACUAUGCAUUUUAAAGUUAAA | 1241 | 2970-2990 | UUUAACUUAAAAUGCAUAGUGA | 1242 | 2968-2990 |
| AD-392975 | UUCCAUGACUGCAUUUUACUU | 1243 | 3029-3049 | AAGUAAAAUGCAGUCAUGGAAAA | 1244 | 3027-3049 |
| AD-392938 | CUGCAUUUUACUGUACAGAUU | 1245 | 3037-3057 | AAUCUGTACAGUAAAAUGCAGUC | 1246 | 3035-3057 |

TABLE 3-continued

APP Unmodified Sequences, Human NM_000484 Targeting

| Duplex Name | Sense Sequence (5' to 3') | SEQ ID NO | Position in NM_000484 | Antisense Sequence (5' to 3') | SEQ ID NO | Position in NM_000484 |
|---|---|---|---|---|---|---|
| AD-392755 | AUUGCUGCUUCUGCUAUAUUU | 1247 | 3055-3075 | AAAUAUAGCAGAAGCAGCAAUCU | 1248 | 3053-3075 |
| AD-392939 | UUCUGCUAUAUUUGUGAUAUA | 1249 | 3063-3083 | UAUAUCACAAAUAUAGCAGAAGC | 1250 | 3061-3083 |
| AD-392940 | UCUGCUAUAUUUGUGAUAUAU | 1251 | 3064-3084 | AUAUAUCACAAAUAUAGCAGAAG | 1252 | 3062-3084 |
| AD-392756 | UGCUAUAUUUGUGAUAUAGGA | 1253 | 3066-3086 | UCCUAUAUCACAAAUAUAGCAGA | 1254 | 3064-3086 |
| AD-392774 | UUUGUGAUAUAGGAAUUAAGA | 1255 | 3073-3093 | UCUUAAUUCCUAUAUCACAAAUA | 1256 | 3071-3093 |
| AD-392850 | UCUUCGUGCCUGUUUUAUGUU | 1257 | 3111-3131 | AACAUAAAACAGGCACGAAGAAA | 1258 | 3109-3131 |
| AD-392852 | CUUCGUGCCUGUUUUAUGUGU | 1259 | 3112-3132 | ACACAUAAAACAGGCACGAAGAA | 1260 | 3110-3132 |
| AD-392830 | GUUUUAUGUGCACACAUUAGU | 1261 | 3122-3142 | ACUAAUGUGUGCACAUAAAACAG | 1262 | 3120-3142 |
| AD-392808 | UGUGCACACAUUAGGCAUUGA | 1263 | 3128-3148 | UCAAUGCCUAAUGUGUGCACAUA | 1264 | 3126-3148 |
| AD-392793 | UGCACACAUUAGGCAUUGAGA | 1265 | 3130-3150 | UCUCAAUGCCUAAUGUGUGCACA | 1266 | 3128-3150 |
| AD-392757 | ACACAUUAGGCAUUGAGACUU | 1267 | 3133-3153 | AAGUCUCAAUGCCUAAUGUGUGC | 1268 | 3131-3153 |
| AD-392747 | UUUGUCCACGUAUCUUUGGGU | 1269 | 3168-3188 | ACCCAAAGAUACGUGGACAAAAA | 1270 | 3166-3188 |
| AD-392902 | CACGUAUCUUUGGGUCUUUGA | 1271 | 3174-3194 | UCAAAGACCCAAAGAUACGUGGA | 1272 | 3172-3194 |
| AD-392941 | ACGUAUCUUUGGGUCUUUGAU | 1273 | 3175-3195 | AUCAAAGACCCAAAGAUACGUGG | 1274 | 3173-3195 |
| AD-392942 | UCUUUGGGUCUUUGAUAAAGA | 1275 | 3180-3200 | UCUUUAUCAAAGACCCAAAGAUA | 1276 | 3178-3200 |
| AD-392943 | CUUUGGGUCUUUGAUAAAGAA | 1277 | 3181-3201 | UUCUUUAUCAAAGACCCAAAGAU | 1278 | 3179-3201 |
| AD-392944 | UUGGGUCUUUGAUAAAGAAAA | 1279 | 3183-3203 | UUUUCUUAUCAAAGACCCAAAG | 1280 | 3181-3203 |
| AD-392903 | UGGGUCUUUGAUAAAGAAAAU | 1281 | 3184-3204 | AUUUUCUUUAUCAAAGACCCAAA | 1282 | 3182-3204 |
| AD-392775 | AAAGAAUCCCUGUUCAUUGUA | 1283 | 3201-3221 | UACAAUGAACAGGGAUUCUUUUC | 1284 | 3199-3221 |
| AD-392758 | AAGAAUCCCUGUUCAUUGUAA | 1285 | 3202-3222 | UUACAAUGAACAGGGAUUCUUUU | 1286 | 3200-3222 |
| AD-392945 | AGAAUCCCUGUUCAUUGUAAU | 1287 | 3203-3223 | AUUACAAUGAACAGGGAUUCUUU | 1288 | 3201-3223 |
| AD-392946 | GAAUCCCUGUUCAUUGUAAGU | 1289 | 3204-3224 | ACUUACAAUGAACAGGGAUUCUU | 1290 | 3202-3224 |
| AD-392884 | UGUUCAUUGUAAGCACUUUUA | 1291 | 3211-3231 | UAAAAGUGCUUACAAUGAACAGG | 1292 | 3209-3231 |
| AD-392947 | GUUCAUUGUAAGCACUUUUAU | 1293 | 3212-3232 | AUAAAAGUGCUUACAAUGAACAG | 1294 | 3210-3232 |
| AD-392748 | UCAUUGUAAGCACUUUUACGU | 1295 | 3214-3234 | ACGUAAAAGUGCUUACAAUGAAC | 1296 | 3212-3234 |
| AD-392759 | CAUUGUAAGCACUUUUACGGU | 1297 | 3215-3235 | ACCGUAAAAGUGCUUACAAUGAA | 1298 | 3213-3235 |
| AD-392837 | CUGGUCUUCAAUUACCAAGAA | 1299 | 3258-3278 | UUCUUGGUAAUUGAAGACCAGCA | 1300 | 3256-3278 |
| AD-392970 | GGUCUUCAAUUACCAAGAAUU | 1301 | 3260-3280 | AAUUCUGGUAAUUGAAGACCAG | 1302 | 3258-3280 |
| AD-392976 | UCUUCAAUUACCAAGAAUUCU | 1303 | 3262-3282 | AGAAUUCUUGGUAAUUGAAGACC | 1304 | 3260-3282 |
| AD-392965 | CUUCAAUUACCAAGAAUUCUU | 1305 | 3263-3283 | AAGAAUCUUGGUAAUUGAAGAC | 1306 | 3261-3283 |
| AD-392831 | UUCAAUUACCAAGAAUUCUCU | 1307 | 3264-3284 | AGAGAAUCUUGGUAAUUGAAGA | 1308 | 3262-3284 |
| AD-392904 | UCAAUUACCAAGAAUUCUCCA | 1309 | 3265-3285 | UGGAGAAUUCUUGGUAAUUGAAG | 1310 | 3263-3285 |
| AD-392885 | AAUUACCAAGAAUUCUCCAAA | 1311 | 3267-3287 | UUUGGAGAAUUCUUGGUAAUUGA | 1312 | 3265-3287 |
| AD-392886 | UUACCAAGAAUUCUCCAAAAU | 1313 | 3269-3289 | AUUUUGGAGAAUUCUUGGUAAUU | 1314 | 3267-3289 |
| AD-392776 | UGAUUGUACAGAAUCAUUGCU | 1315 | 3304-3324 | AGCAAUGAUUCUGUACAAUCAUC | 1316 | 3302-3324 |
| AD-392887 | UCAUUGCUUAUGACAUGAUCU | 1317 | 3317-3337 | AGAUCATGUCAUAAGCAAUGAUU | 1318 | 3315-3337 |
| AD-392722 | CAUUGCUUAUGACAUGAUCGU | 1319 | 3318-3338 | ACGAUCAUGUCAUAAGCAAUGAU | 1320 | 3316-3338 |

TABLE 3-continued

APP Unmodified Sequences, Human NM_000484 Targeting

| Duplex Name | Sense Sequence (5' to 3') | SEQ ID NO | Position in NM_000484 | Antisense Sequence (5' to 3') | SEQ ID NO | Position in NM_000484 |
|---|---|---|---|---|---|---|
| AD-392740 | AUUGCUUAUGACAUGAUCGCU | 1321 | 3319-3339 | AGCGAUCAUGUCAUAAGCAAUGA | 1322 | 3317-3339 |
| AD-392760 | UUGCUUAUGACAUGAUCGCUU | 1323 | 3320-3340 | AAGCGATCAUGUCAUAAGCAAUG | 1324 | 3318-3340 |
| AD-392731 | UGCUUAUGACAUGAUCGCUUU | 1325 | 3321-3341 | AAAGCGAUCAUGUCAUAAGCAAU | 1326 | 3319-3341 |
| AD-392709 | GCUUAUGACAUGAUCGCUUUC | 1327 | 3322-3342 | GAAAGCGAUCAUGUCAUAAGCAA | 1328 | 3320-3342 |
| AD-392723 | CUUAUGACAUGAUCGCUUUCU | 1329 | 3323-3343 | AGAAAGCGAUCAUGUCAUAAGCA | 1330 | 3321-3343 |
| AD-392948 | UUAUGACAUGAUCGCUUUCUA | 1331 | 3324-3344 | UAGAAAGCGAUCAUGUCAUAAGC | 1332 | 3322-3344 |
| AD-392724 | UAUGACAUGAUCGCUUUCUAU | 1333 | 3325-3345 | AUAGAAAGCGAUCAUGUCAUAAG | 1334 | 3323-3345 |
| AD-392949 | AUGACAUGAUCGCUUUCUACA | 1335 | 3326-3346 | UGUAGAAAGCGAUCAUGUCAUAA | 1336 | 3324-3346 |
| AD-392725 | UGACAUGAUCGCUUUCUACAU | 1337 | 3327-3347 | AUGUAGAAAGCGAUCAUGUCAUA | 1338 | 3325-3347 |
| AD-392950 | CAUGAUCGCUUUCUACACUGU | 1339 | 3330-3350 | ACAGUGUAGAAAGCGAUCAUGUC | 1340 | 3328-3350 |
| AD-392732 | UGAUCGCUUUCUACACUGUAU | 1341 | 3332-3352 | AUACAGUGUAGAAAGCGAUCAUG | 1342 | 3330-3352 |
| AD-392726 | GAUCGCUUUCUACACUGUAUU | 1343 | 3333-3353 | AAUACAGUGUAGAAAGCGAUCAU | 1344 | 3331-3353 |
| AD-392733 | AUCGCUUUCUACACUGUAUUA | 1345 | 3334-3354 | UAAUACAGUGUAGAAAGCGAUCA | 1346 | 3332-3354 |
| AD-392906 | UCGCUUUCUACACUGUAUUAU | 1347 | 3335-3355 | AUAAUACAGUGUAGAAAGCGAUC | 1348 | 3333-3355 |
| AD-392862 | CGCUUUCUACACUGUAUUACA | 1349 | 3336-3356 | UGUAAUACAGUGUAGAAAGCGAU | 1350 | 3334-3356 |
| AD-392951 | CUUUCUACACUGUAUUACAUA | 1351 | 3338-3358 | UAUGUAAUACAGUGUAGAAAGCG | 1352 | 3336-3358 |
| AD-392871 | UUCUACACUGUAUUACAUAAA | 1353 | 3340-3360 | UUUAUGUAAUACAGUGUAGAAAG | 1354 | 3338-3360 |
| AD-392872 | UCUACACUGUAUUACAUAAAU | 1355 | 3341-3361 | AUUUAUGUAAUACAGUGUAGAAA | 1356 | 3339-3361 |
| AD-392952 | GAUUCAAUUUUCUUUAACCAU | 1357 | 3456-3476 | AUGGUUAAAGAAAAUUGAAUCUG | 1358 | 3454-3476 |
| AD-392907 | AUUUCUUUAACCAGUCUGAA | 1359 | 3462-3482 | UUCAGACUGGUUAAAGAAAAUUG | 1360 | 3460-3482 |
| AD-392953 | UUUCUUUAACCAGUCUGAAGU | 1361 | 3464-3484 | ACUUCAGACUGGUUAAAGAAAAU | 1362 | 3462-3484 |
| AD-392741 | UCUUUAACCAGUCUGAAGUUU | 1363 | 3466-3486 | AAACUUCAGACUGGUUAAAGAAA | 1364 | 3464-3486 |
| AD-392908 | CUUUAACCAGUCUGAAGUUUC | 1365 | 3467-3487 | GAAACUTCAGACUGGUUAAAGAA | 1366 | 3465-3487 |
| AD-392977 | CUGAAGUUUCAUUUAUGAUAU | 1367 | 3478-3498 | AUAUCAUAAAUGAAACUUCAGAC | 1368 | 3476-3498 |
| AD-392847 | GAAGUUUCAUUUAUGAUACAA | 1369 | 3480-3500 | UUGUAUCAUAAAUGAAACUUCAG | 1370 | 3478-3500 |
| AD-392809 | AAAUGGAAGUGGCAAUAUAAU | 1371 | 3511-3531 | AUUAUAUGCCACUUCCAUUUUC | 1372 | 3509-3531 |
| AD-392810 | AUGGAAGUGGCAAUAUAAGGU | 1373 | 3513-3533 | ACCUUAUAUUGCCACUUCCAUUU | 1374 | 3511-3533 |
| AD-392777 | UGCCUGGACAAACCCUUCUUU | 1375 | 3547-3567 | AAAGAAGGGUUUGUCCAGGCAUG | 1376 | 3545-3567 |
| AD-392960 | UUCUUUAAGAUGUGUCUUCA | 1377 | 3562-3582 | UGAAGACACAUCUUAAAAGAAGG | 1378 | 3560-3582 |
| AD-392873 | CUUUAAGAUGUGUCUUCAAU | 1379 | 3564-3584 | AUUGAAGACACAUCUUAAAAGAA | 1380 | 3562-3584 |
| AD-392889 | UUUAAGAUGUGUCUUCAAUU | 1381 | 3565-3585 | AAUUGAAGACACAUCUUAAAAGA | 1382 | 3563-3585 |
| AD-392954 | UUUAAGAUGUGUCUUCAAUUU | 1383 | 3566-3586 | AAAUUGAAGACACAUCUUAAAAG | 1384 | 3564-3586 |
| AD-392955 | UUAAGAUGUGUCUUCAAUUUG | 1385 | 3567-3587 | CAAAUUGAAGACACAUCUUAAAA | 1386 | 3565-3587 |
| AD-392909 | UAAGAUGUGUCUUCAAUUUGU | 1387 | 3568-3588 | ACAAAUGAAGACACAUCUUAAA | 1388 | 3566-3588 |
| AD-392710 | AAGAUGUGUCUUCAAUUUGUA | 1389 | 3569-3589 | UACAAAUGAAGACACAUCUUAA | 1390 | 3567-3589 |
| AD-392956 | AGAUGUGUCUUCAAUUUGUAU | 1391 | 3570-3590 | AUACAAAUUGAAGACACAUCUUA | 1392 | 3568-3590 |
| AD-392874 | AUGUGUCUUCAAUUUGUAUAA | 1393 | 3572-3592 | UUAUACAAAUUGAAGACACAUCU | 1394 | 3570-3592 |

TABLE 3-continued

APP Unmodified Sequences, Human NM_000484 Targeting

| Duplex Name | Sense Sequence (5' to 3') | SEQ ID NO | Position in NM_000484 | Antisense Sequence (5' to 3') | SEQ ID NO | Position in NM_000484 |
|---|---|---|---|---|---|---|
| AD-392957 | UGUCUUCAAUUUGUAUAAAAU | 1395 | 3575-3595 | AUUUUAUACAAAUUGAAGACACA | 1396 | 3573-3595 |
| AD-392958 | CUUCAAUUGUAUAAAAUGGU | 1397 | 3578-3598 | ACCAUUUAUACAAAUUGAAGAC | 1398 | 3576-3598 |
| AD-392959 | AUGGUGUUUUCAUGUAAAUAA | 1399 | 3594-3614 | UUAUUUACAUGAAAACACCAUUU | 1400 | 3592-3614 |
| AD-392788 | GUAAAUAAAUACAUUCUUGGA | 1401 | 3607-3627 | UCCAAGAAUGUAUUUAUUUACAU | 1402 | 3605-3627 |

TABLE 4

APP Single Dose Screen in Primary Cynomolgus Hepatocytes and Be(2)C Cell Line
Data are expressed as percent message remaining relative to AD-1955 non-targeting control.

| Duplex Name | Primary Cynomolgus Hepatocytes | | | | Be(2)C Cell Line | | | |
|---|---|---|---|---|---|---|---|---|
| | 10 nM Avg | 10 nM SD | 0.1 nM Avg | 0.1 nM SD | 10 nM Avg | 10 nM SD | 0.1 nM Avg | 0.1 nM SD |
| AD-392853 | 92 | 5 | 89.9 | 1.5 | 97 | 2.5 | 99.3 | 8.8 |
| AD-392857 | 86.7 | 3.3 | 98.9 | 6.1 | 85.1 | 4.4 | 103.8 | 5.9 |
| AD-392851 | 90.5 | 1.5 | 97.9 | 10.1 | 100.1 | 4 | 103.9 | 7.8 |
| AD-392811 | 90.5 | 10.5 | 87.8 | 2.5 | 89.1 | 6.8 | 98 | 5.1 |
| AD-392910 | 52.3 | 3 | 99.2 | 32.4 | 66.1 | 6.1 | 101.3 | 9.7 |
| AD-392890 | 57.4 | 4.8 | 108.5 | 23.1 | 63.9 | 1.5 | 100.3 | 10.6 |
| AD-392911 | 16.4 | 3.4 | 85.7 | 4 | 10.6 | 3.5 | 71.2 | 10.3 |
| AD-392912 | 16.7 | 2.7 | 84.8 | 4.5 | 9.7 | 1.7 | 57.7 | 4.1 |
| AD-392778 | 46.1 | 19.2 | 96 | 23.4 | 7.9 | 0.9 | 82.4 | 7.4 |
| AD-392727 | 52.9 | 5.8 | 98.9 | 11.4 | 48.3 | 4.5 | 94 | 5.7 |
| AD-392728 | 43.8 | 20.3 | 91.5 | 10.2 | 17.6 | 2.2 | 86.2 | 6.5 |
| AD-392891 | 52 | 7 | 142.2 | 35.1 | 34.8 | 1.7 | 93.5 | 5.8 |
| AD-392822 | 53.9 | 3.8 | 75.2 | 2.9 | 30.1 | 3.2 | 83.7 | 5.8 |
| AD-392749 | 46.3 | 11.7 | 97.6 | 2.6 | 14.9 | 1.7 | 95.7 | 5.3 |
| AD-392794 | 108.8 | 17.9 | 86.9 | 2.7 | 92.9 | 7.9 | 87.4 | 6.7 |
| AD-392795 | 39.5 | 13.2 | 78.1 | 11.8 | 15.5 | 1.8 | 79.9 | 7.9 |
| AD-392812 | 87.2 | 4.3 | 90.4 | 2.5 | 79.8 | 3.3 | 78.5 | 13.8 |
| AD-392796 | 48 | 17.6 | 82.6 | 2.8 | 17.1 | 2.5 | 80.2 | 3.5 |
| AD-392779 | 100 | 30.9 | 95.9 | 4.8 | 99.6 | 4 | 98.6 | 3.3 |
| AD-392780 | 80.7 | 29.5 | 93.2 | 4.5 | 47.4 | 4.4 | 101.6 | 5.2 |
| AD-392813 | 91.6 | 2.9 | 85.1 | 4 | 84.8 | 4.7 | 88.9 | 7 |
| AD-392797 | 98 | 6.6 | 88.7 | 11.1 | 79 | 3.3 | 84 | 12 |
| AD-392761 | 73.9 | 18.4 | 94.2 | 4.3 | 77.9 | 4.4 | 101 | 6.4 |
| AD-392814 | 56.9 | 2.9 | 84.4 | 5.4 | 47.5 | 2.6 | 83.8 | 6.6 |
| AD-392742 | 89 | 21.9 | 99.4 | 8.2 | 48.1 | 5.8 | 96.6 | 3.7 |
| AD-392750 | 110.7 | 44.7 | 99.9 | 13.2 | 25.4 | 1.2 | 95 | 4.7 |
| AD-392823 | 65.5 | 3 | 73.7 | 2.9 | 38.8 | 4.1 | 84.9 | 3.8 |
| AD-392789 | 103.7 | 4 | 105 | 3.8 | 88.1 | 7 | 79.5 | 4 |
| AD-392781 | 81 | 39.1 | 94.9 | 5.8 | 21.2 | 3.1 | 95 | 8.9 |
| AD-392798 | 119.2 | 16.3 | 85.3 | 10.9 | 73.1 | 6.3 | 83.2 | 7.4 |
| AD-392751 | 48.5 | 12.9 | 93.9 | 7.9 | 15.6 | 3 | 87.2 | 2.5 |
| AD-392858 | 90 | 1.5 | 95 | 2.6 | 90.7 | 4.7 | 103 | 7.7 |
| AD-392844 | 21.8 | 0.4 | 93 | 3.6 | 6.2 | 0.6 | 51.8 | 5.3 |
| AD-392842 | 88.9 | 0.5 | 98.2 | 1.6 | 67.7 | 4.1 | 102 | 2.7 |
| AD-392848 | 91.7 | 9.1 | 90.1 | 2.6 | 70.9 | 7.5 | 96.5 | 16.7 |
| AD-392838 | 68 | 3.6 | 90.2 | 3.3 | 20.2 | 2 | 84.3 | 6.2 |
| AD-392839 | 69 | 2.6 | 84.8 | 3.9 | 62.7 | 3.1 | 85.8 | 7.6 |
| AD-392734 | 103 | 32.4 | 112.8 | 23.5 | 86.6 | 6.6 | 98.6 | 3.1 |
| AD-392790 | 34 | 4.8 | 99.2 | 1.2 | 10.9 | 1.4 | 72.6 | 2.5 |
| AD-392815 | 37.4 | 1.7 | 82.5 | 2.9 | 21.5 | 1.9 | 79.8 | 0.9 |
| AD-392762 | 72.2 | 21.3 | 95 | 12.3 | 91.2 | 4.6 | 102.6 | 7.7 |
| AD-392735 | 47 | 9.7 | 101.5 | 9.2 | 29.6 | 4.4 | 94 | 7.4 |
| AD-392743 | 73.6 | 23.4 | 105.5 | 16.6 | 58.5 | 2.6 | 100.1 | 11.3 |
| AD-392736 | 50.5 | 9 | 97.3 | 8.2 | 19.6 | 2.4 | 91.7 | 7 |
| AD-392824 | 22.6 | 6.7 | 65.8 | 4.9 | 6.4 | 1.6 | 54.9 | 5 |
| AD-392799 | 90.1 | 23.6 | 75.8 | 4.5 | 35.7 | 5.4 | 78.2 | 7.5 |
| AD-392971 | 89.2 | 13.4 | 92.1 | 0.3 | 57.1 | 3.6 | 91.8 | 5.8 |
| AD-392913 | 18.4 | 2.7 | 78.1 | 8 | 7.4 | 0.2 | 45.7 | 2.1 |
| AD-392892 | 61 | 12.4 | 113.2 | 8.6 | 57.4 | 5.4 | 89.7 | 13.2 |
| AD-392914 | 80.3 | 6.3 | 103.2 | 5.9 | 86.5 | 3.4 | 111.4 | 19.7 |
| AD-392860 | 91.8 | 4.8 | 89.4 | 6.1 | 106.1 | 6.2 | 98.6 | 5.6 |
| AD-392875 | 96.2 | 4.8 | 107.9 | 2.5 | 66.1 | 2.9 | 83.5 | 8.4 |

TABLE 4-continued

APP Single Dose Screen in Primary Cynomolgus Hepatocytes and Be(2)C Cell Line
Data are expressed as percent message remaining relative to AD-1955 non-targeting control.

| Duplex Name | Primary Cynomolgus Hepatocytes | | | | Be(2)C Cell Line | | | |
|---|---|---|---|---|---|---|---|---|
| | 10 nM Avg | 10 nM SD | 0.1 nM Avg | 0.1 nM SD | 10 nM Avg | 10 nM SD | 0.1 nM Avg | 0.1 nM SD |
| AD-392915 | 48.1 | 1.8 | 101.9 | 4.8 | 38.3 | 3.4 | 103 | 5.4 |
| AD-392782 | 109.4 | 4.8 | 95.4 | 5.3 | 72.2 | 4.3 | 101.6 | 2.7 |
| AD-392763 | 60 | 17.6 | 93 | 6.3 | 26.7 | 2.2 | 91.6 | 3.8 |
| AD-392816 | 40.2 | 1.5 | 74.6 | 2.2 | 15.6 | 1.2 | 78.9 | 2.4 |
| AD-392704 | 28.7 | 12.1 | 94.1 | 6.8 | 15.8 | 1.5 | 65.7 | 9.7 |
| AD-392854 | 89 | 3.5 | 84.9 | 2.9 | 99 | 7 | 97.9 | 5.8 |
| AD-392856 | 93.7 | 2.5 | 88.4 | 2.8 | 101 | 7.8 | 94.2 | 3.5 |
| AD-392817 | 101.6 | 3 | 85 | 5.2 | 77.5 | 11.4 | 98.6 | 11.6 |
| AD-392764 | 69.5 | 12.1 | 87.2 | 5.9 | 10.6 | 1.4 | 79.4 | 5.7 |
| AD-392845 | 89.5 | 2 | 99 | 8.2 | 50.4 | 5 | 90.5 | 2.9 |
| AD-392825 | 38.1 | 2.5 | 98 | 8.4 | 14.7 | 4.7 | 91.4 | 4 |
| AD-392849 | 89.4 | 4.1 | 92.3 | 11.4 | 30.3 | 2.3 | 103.4 | 7.4 |
| AD-392846 | 83.1 | 1.9 | 99.7 | 6.3 | 17.6 | 3.2 | 77.7 | 4.2 |
| AD-392859 | 82 | 2.5 | 91.4 | 5.5 | 69.7 | 1.5 | 98.6 | 2.1 |
| AD-392843 | 18.8 | 2.1 | 88.9 | 5.4 | 7.4 | 2.5 | 37.2 | 2.2 |
| AD-392855 | 64 | 5.2 | 85.9 | 12.4 | 23.4 | 2.6 | 85.6 | 9.1 |
| AD-392840 | 74.3 | 2.3 | 91.2 | 6.4 | 27.7 | 2.5 | 94.3 | 15.6 |
| AD-392835 | 18.2 | 2.3 | 84.3 | 5.4 | 12.7 | 3.1 | 53.5 | 4.5 |
| AD-392729 | 46.9 | 13.7 | 100.9 | 20.5 | 13.3 | 2.3 | 82.4 | 4.2 |
| AD-392916 | 20 | 1.6 | 63.7 | 3.6 | 7.5 | 2 | 44.4 | 2.1 |
| AD-392876 | 45.8 | 4.6 | 100.8 | 2.6 | 16.4 | 3.6 | 67.4 | 7.2 |
| AD-392861 | 91.9 | 3.9 | 89.3 | 2.6 | 89.9 | 10.9 | 91.5 | 4.3 |
| AD-392863 | 22.8 | 0.6 | 90.1 | 9.3 | 9.9 | 1.9 | 72.2 | 8 |
| AD-392917 | 30.6 | 1.8 | 99.7 | 2.1 | 21.7 | 3.5 | 82.5 | 7.5 |
| AD-392783 | 22.8 | 1.7 | 90.4 | 11.1 | 13.1 | 1.4 | 69.8 | 5.7 |
| AD-392765 | 79 | 22 | 83.3 | 6.4 | 22.4 | 2.8 | 68.1 | 5.7 |
| AD-392791 | 31.9 | 7.6 | 84.1 | 4.8 | 11.2 | 1.2 | 52.3 | 2.4 |
| AD-392800 | 38.2 | 3.6 | 72.3 | 7.6 | 8 | 1.5 | 65.4 | 7.2 |
| AD-392711 | 38.1 | 24.1 | 115.1 | 21 | 18.8 | 0.6 | 67.2 | 2.2 |
| AD-392801 | 18.7 | 0.6 | 87 | 6.3 | 11.7 | 3 | 66.3 | 17.5 |
| AD-392826 | 69 | 4.6 | 95.1 | 10 | 31.9 | 3.3 | 88.4 | 8 |
| AD-392818 | 31.5 | 2.2 | 77.8 | 6.6 | 18.6 | 3 | 80.7 | 6.2 |
| AD-392792 | 35.8 | 6.7 | 87.7 | 4.1 | 10.7 | 1.1 | 58.3 | 4.7 |
| AD-392802 | 43.8 | 4.1 | 81.8 | 7.5 | 26.5 | 3.7 | 90.3 | 2.6 |
| AD-392766 | 32.8 | 11.5 | 75.2 | 4.1 | 8.4 | 2 | 38.1 | 3.5 |
| AD-392767 | 64 | 23.5 | 87.5 | 5.2 | 10.7 | 1.5 | 66.1 | 5.8 |
| AD-392834 | 84.6 | 2.8 | 85.1 | 6.9 | 7.8 | 0.8 | 68.1 | 4.7 |
| AD-392974 | 118.3 | 5.4 | 105.4 | 6.3 | 9.3 | 0.9 | 53.1 | 4.5 |
| AD-392784 | 63.6 | 14.9 | 92.8 | 0.8 | 28.1 | 3.4 | 96.7 | 6.5 |
| AD-392744 | 59.6 | 17.2 | 96.6 | 7.4 | 18.3 | 1 | 92.7 | 7.7 |
| AD-392752 | 38.2 | 11.6 | 92.8 | 4.9 | 7.7 | 1.2 | 57.6 | 2.3 |
| AD-392737 | 44.8 | 38.6 | 103.9 | 27.2 | 9.7 | 0.7 | 57.3 | 3.4 |
| AD-392712 | 73 | 38.4 | 102.8 | 6.1 | 37.2 | 1.9 | 67.4 | 16 |
| AD-392705 | 25.2 | 9.4 | 88.7 | 4.3 | 6.6 | 0.9 | 47.7 | 6.3 |
| AD-392713 | 81.8 | 33.4 | 101.1 | 7.3 | 61.7 | 5.8 | 92.7 | 9.8 |
| AD-392918 | 25.1 | 1.8 | 93.5 | 5.3 | 18.5 | 1 | 95 | 11.2 |
| AD-392919 | 24.3 | 3.3 | 95 | 8.6 | 13.8 | 4 | 78 | 9.1 |
| AD-392803 | 51.5 | 3.1 | 89.5 | 9.4 | 19.8 | 2 | 72 | 3 |
| AD-392804 | 72 | 3.3 | 97.2 | 11.3 | 22.9 | 1.2 | 83.1 | 3.2 |
| AD-392827 | 24.1 | 1.5 | 87 | 9.2 | 11.7 | 1.7 | 72.7 | 5.9 |
| AD-392828 | 67.5 | 3.7 | 102.4 | 13.8 | 33.7 | 3.2 | 81.9 | 3.9 |
| AD-392785 | 39.5 | 14.4 | 70.2 | 15 | 5.6 | 1.2 | 37.4 | 3.9 |
| AD-392829 | 26.5 | 2.8 | 87.5 | 7.5 | 16.1 | 1.6 | 73 | 7.4 |
| AD-392920 | 35.8 | 3.5 | 108.1 | 4.7 | 19.9 | 4.3 | 94.4 | 6.7 |
| AD-392921 | 30 | 3.8 | 100.7 | 9.1 | 11.9 | 2.8 | 75 | 7.6 |
| AD-392768 | 66.5 | 21.9 | 94.1 | 6.6 | 13.1 | 2.7 | 84.9 | 5.8 |
| AD-392805 | 20.5 | 0.9 | 88.7 | 13.4 | 7.9 | 2.2 | 43.5 | 3.9 |
| AD-392769 | 41.9 | 21.5 | 74.6 | 4.6 | 4.9 | 2.1 | 32.5 | 3.9 |
| AD-392753 | 40.4 | 7.6 | 113.9 | 21.9 | 12.5 | 0.9 | 72.5 | 7.6 |
| AD-392714 | 21.7 | 8.1 | 99.5 | 7.2 | 6.9 | 0.8 | 40.8 | 3.2 |
| AD-392703 | 17.6 | 1.5 | 90.5 | 6.9 | 6.2 | 1.4 | 37.7 | 3.9 |
| AD-392715 | 25.5 | 10.3 | 78.8 | 4.8 | 6.4 | 1.7 | 38.9 | 2.7 |
| AD-392841 | 89.6 | 3.9 | 93.6 | 9 | 36.8 | 4.1 | 96.6 | 6.9 |
| AD-392836 | 88.5 | 1.6 | 97.7 | 8.6 | 7.6 | 2 | 51.5 | 2 |
| AD-392966 | 71.5 | 4.6 | 92.4 | 3.4 | 6.4 | 1 | 47.6 | 4.2 |
| AD-392832 | 94.7 | 7.9 | 85.4 | 14.4 | 23.8 | 3.2 | 76.2 | 2.6 |
| AD-392972 | 84.1 | 10.8 | 89.8 | 7.1 | 8.3 | 2 | 57.1 | 3.5 |
| AD-392961 | 82.6 | 7.5 | 111.3 | 9.9 | 8 | 0.4 | 51.7 | 5.1 |
| AD-392967 | 81.6 | 7.1 | 93.2 | 6.8 | 20.2 | 1.6 | 89.4 | 4.9 |
| AD-392893 | 64.8 | 11.7 | 118.8 | 19.7 | 59.9 | 2.6 | 80.7 | 5.1 |
| AD-392894 | 68.4 | 10.3 | 111.4 | 10.8 | 21.9 | 1.5 | 88.4 | 15.6 |

TABLE 4-continued

APP Single Dose Screen in Primary Cynomolgus Hepatocytes and Be(2)C Cell Line
Data are expressed as percent message remaining relative to AD-1955 non-targeting control.

| Duplex Name | Primary Cynomolgus Hepatocytes | | | | Be(2)C Cell Line | | | |
|---|---|---|---|---|---|---|---|---|
| | 10 nM Avg | 10 nM SD | 0.1 nM Avg | 0.1 nM SD | 10 nM Avg | 10 nM SD | 0.1 nM Avg | 0.1 nM SD |
| AD-392864 | 62.7 | 15.4 | 88.4 | 6.2 | 8.2 | 0.8 | 55.9 | 4.5 |
| AD-392865 | 45.8 | 2.4 | 103.8 | 12.6 | 13.6 | 3.1 | 35.8 | 5.4 |
| AD-392922 | 43.3 | 5 | 106.5 | 2.2 | 11.1 | 5.2 | 53.1 | 4.9 |
| AD-392833 | 95.1 | 5.1 | 93.9 | 4.1 | 21.2 | 0.7 | 86.2 | 0.8 |
| AD-392968 | 54.3 | 3.1 | 94.8 | 9.3 | 8.2 | 0.7 | 51.9 | 2.5 |
| AD-392962 | 82.3 | 10.9 | 103 | 10 | 8.5 | 0.5 | 55 | 3.8 |
| AD-392963 | 63.9 | 8.9 | 99.6 | 10.3 | 19.5 | 0.5 | 71.2 | 1.1 |
| AD-392964 | 94.4 | 8.6 | 97.5 | 9.2 | 52.4 | 3.7 | 87.1 | 2.8 |
| AD-392969 | 73.3 | 6.6 | 99 | 6.2 | 11.7 | 1.1 | 69.4 | 2.5 |
| AD-392973 | 69 | 12.8 | 87.7 | 8 | 7.6 | 0.7 | 67.3 | 1.7 |
| AD-392923 | 28.6 | 3.3 | 106 | 8.2 | 13.2 | 3.5 | 69.6 | 12.7 |
| AD-392866 | 18 | 4.3 | 86.5 | 14.1 | 9.1 | 0.8 | 29.1 | 8.6 |
| AD-392924 | 79.7 | 3.1 | 108.3 | 5.2 | 89 | 3.1 | 94.8 | 7.7 |
| AD-392895 | 63.4 | 13.8 | 109 | 4.4 | 31.6 | 2.9 | 86.7 | 8.9 |
| AD-392867 | 95.2 | 11.6 | 99.8 | 15.8 | 45.3 | 1.7 | 77.1 | 6.6 |
| AD-392877 | 74.8 | 23.6 | 102.2 | 7.6 | 14.3 | 2 | 54.1 | 1.7 |
| AD-392707 | 27.1 | 7.6 | 87.9 | 5.5 | 6 | 1.4 | 68.8 | 1.9 |
| AD-392716 | 107.6 | 19.9 | 100.9 | 7.9 | 45.4 | 4 | 94.6 | 3.6 |
| AD-392925 | 47 | 5.6 | 106.8 | 5.1 | 23.1 | 2.4 | 80.7 | 9.3 |
| AD-392926 | 22.1 | 2.5 | 93.7 | 8.7 | 7.7 | 0.7 | 67 | 9.8 |
| AD-392927 | 18.2 | 5.4 | 80.1 | 8.7 | 9.7 | 2 | 44.2 | 6.4 |
| AD-392717 | 57.4 | 16 | 84.6 | 9.4 | 8.7 | 0.9 | 52.2 | 3.7 |
| AD-392928 | 71.3 | 4 | 95.4 | 4.1 | 35.3 | 2.7 | 103 | 8.5 |
| AD-392700 | 23 | 7.6 | 88.4 | 4.8 | 6.3 | 0.6 | 45.3 | 10.7 |
| AD-392878 | 29.9 | 18.4 | 89 | 4.4 | 8.4 | 1.6 | 34.5 | 4 |
| AD-392718 | 40.3 | 14.5 | 105.4 | 25.7 | 10.8 | 0.6 | 68.5 | 2.3 |
| AD-392929 | 42.4 | 3.7 | 99.5 | 1.2 | 15 | 4.9 | 88.8 | 14.1 |
| AD-392879 | 102.2 | 14.5 | 97.7 | 3.5 | 59.6 | 3 | 67.3 | 8.1 |
| AD-392754 | 97.1 | 14.7 | 102.1 | 17.6 | 27.3 | 2.5 | 108.6 | 5.7 |
| AD-392819 | 22.3 | 2.2 | 79.6 | 4.9 | 11 | 2.5 | 58.4 | 4.9 |
| AD-392745 | 13.8 | 2.2 | 74 | 13.1 | 7.1 | 1.9 | 28.2 | 4 |
| AD-392770 | 36.9 | 18 | 80.3 | 8.1 | 6.7 | 1 | 34.1 | 4.1 |
| AD-392806 | 44.9 | 3.3 | 84.2 | 3.9 | 17.7 | 2.6 | 54.3 | 1.9 |
| AD-392771 | 49.4 | 18.6 | 89.4 | 1.6 | 9.5 | 0.4 | 60.1 | 2.9 |
| AD-392820 | 54.4 | 3.3 | 88.1 | 3.9 | 19.6 | 1.1 | 78.1 | 6.4 |
| AD-392821 | 61.1 | 2.2 | 79.8 | 3.1 | 15.5 | 1.6 | 80.1 | 5.3 |
| AD-392786 | 72.2 | 9.8 | 109.4 | 4 | 19.8 | 1.9 | 65.3 | 2.2 |
| AD-392772 | 58.9 | 11.7 | 88.9 | 2.6 | 11 | 0.6 | 62.2 | 3.1 |
| AD-392699 | 37.9 | 9.1 | 102.9 | 8.7 | 8.1 | 3.4 | 55.6 | 4.4 |
| AD-392868 | 52.9 | 1.4 | 95.8 | 11.1 | 18 | 1.8 | 61.5 | 4.3 |
| AD-392719 | 37.4 | 20.3 | 94.7 | 12.4 | 7.3 | 1 | 38.9 | 2.4 |
| AD-392880 | 21.9 | 2 | 83.2 | 3 | 10.9 | 1.5 | 32.7 | 3.3 |
| AD-392930 | 31.4 | 2.5 | 95.8 | 2 | 9.9 | 2.4 | 42.2 | 6 |
| AD-392931 | 75.2 | 7.7 | 98.4 | 4.5 | 44.3 | 4.1 | 108.6 | 12.5 |
| AD-392932 | 34.7 | 5.5 | 99.6 | 4.9 | 12.2 | 0.8 | 54.5 | 5.1 |
| AD-392869 | 21.4 | 1.8 | 92.5 | 12.4 | 6.9 | 1.6 | 29 | 2 |
| AD-392870 | 22.1 | 3.8 | 86 | 13.5 | 9 | 1.2 | 20.7 | 1.6 |
| AD-392896 | 50.7 | 6.7 | 112.8 | 8.3 | 21.9 | 3 | 75.9 | 9.4 |
| AD-392787 | 100.4 | 6.1 | 114.6 | 11.3 | 54.7 | 3.4 | 61.6 | 28.7 |
| AD-392720 | 61.7 | 30 | 87.6 | 4.6 | 6.6 | 0.2 | 34.6 | 4 |
| AD-392746 | 54.4 | 23.1 | 102.1 | 22.9 | 5.7 | 0.7 | 59 | 6.3 |
| AD-392773 | 101.8 | 22 | 97.6 | 6.3 | 30.3 | 1.5 | 97.4 | 6 |
| AD-392807 | 56 | 3.3 | 76 | 4.9 | 11.2 | 1.4 | 64.2 | 4.3 |
| AD-392730 | 53.3 | 8.2 | 102.8 | 22.2 | 28.4 | 1.9 | 91.9 | 5.4 |
| AD-392721 | 43.9 | 21.8 | 93.3 | 6.7 | 7.4 | 0.1 | 58.1 | 1.5 |
| AD-392933 | 51.7 | 6.2 | 88.8 | 3.3 | 22 | 4.4 | 86.3 | 7.8 |
| AD-392934 | 71.4 | 7.1 | 100.9 | 5.6 | 53.7 | 3.7 | 100.1 | 14 |
| AD-392881 | 34.6 | 2 | 104.5 | 1.5 | 11 | 3.9 | 55 | 11 |
| AD-392897 | 47.9 | 5 | 103.3 | 2.7 | 19.2 | 1.9 | 91.7 | 7.3 |
| AD-392898 | 24.7 | 4.3 | 98.9 | 6.7 | 11.6 | 2.4 | 76.1 | 11.5 |
| AD-392708 | 79.7 | 6.2 | 99.5 | 3.8 | 57.8 | 2.5 | 95.7 | 6.3 |
| AD-392899 | 20.7 | 3.4 | 75 | 4.2 | 12.6 | 3 | 57.9 | 5.9 |
| AD-392935 | 25.8 | 2.6 | 85.8 | 2.4 | 9.5 | 1.6 | 44 | 8 |
| AD-392882 | 47.9 | 2 | 101.9 | 4.4 | 15.9 | 2.3 | 77.6 | 9.3 |
| AD-392738 | 43.3 | 10.3 | 98.8 | 7.3 | 9.7 | 1.4 | 88 | 4 |
| AD-392739 | 42.8 | 13.3 | 124.4 | 28 | 16.6 | 0.8 | 82.1 | 4.9 |
| AD-392936 | 26.9 | 3.9 | 91.3 | 2.5 | 11.7 | 0.6 | 45.7 | 11.4 |
| AD-392900 | 36.6 | 1.9 | 96.1 | 5.9 | 11.7 | 1.5 | 64.5 | 4.1 |
| AD-392901 | 49 | 0.9 | 106.8 | 6.4 | 46.2 | 4.3 | 81.8 | 7.1 |
| AD-392937 | 36.7 | 2.7 | 89.6 | 3 | 12.4 | 1.4 | 53 | 7.9 |
| AD-392883 | 30.8 | 2.2 | 96.6 | 4.4 | 8.5 | 1.2 | 55.2 | 3.5 |

TABLE 4-continued

APP Single Dose Screen in Primary Cynomolgus Hepatocytes and Be(2)C Cell Line
Data are expressed as percent message remaining relative to AD-1955 non-targeting control.

| Duplex Name | Primary Cynomolgus Hepatocytes | | | | Be(2)C Cell Line | | | |
|---|---|---|---|---|---|---|---|---|
| | 10 nM Avg | 10 nM SD | 0.1 nM Avg | 0.1 nM SD | 10 nM Avg | 10 nM SD | 0.1 nM Avg | 0.1 nM SD |
| AD-392975 | 112.8 | 2.1 | 106.9 | 2.2 | 27.9 | 1.3 | 95.3 | 5.5 |
| AD-392938 | 33 | 7.9 | 88.1 | 3.2 | 13.2 | 2.9 | 61.6 | 6.9 |
| AD-392755 | 100.8 | 38 | 105.8 | 17.6 | 38.6 | 2.2 | 93.2 | 5.9 |
| AD-392939 | 36.8 | 8 | 96.2 | 4.8 | 9.8 | 3 | 59.1 | 9.1 |
| AD-392940 | 81.3 | 12.4 | 97 | 3.1 | 84.6 | 8.1 | 93.8 | 7.5 |
| AD-392756 | 101.7 | 14.9 | 94.9 | 5.7 | 43.2 | 4.2 | 98.9 | 11.3 |
| AD-392774 | 99.6 | 34.8 | 97.3 | 2.2 | 87.9 | 3.8 | 98.6 | 7.7 |
| AD-392850 | 89.3 | 3.3 | 95.3 | 4.2 | 37.4 | 3.2 | 102.2 | 11.6 |
| AD-392852 | 91.8 | 4.8 | 88.2 | 5.9 | 59.9 | 5.6 | 103.8 | 8.7 |
| AD-392830 | 89.2 | 1.9 | 83.6 | 9.6 | 68.2 | 2.5 | 89.6 | 3.7 |
| AD-392808 | 44.2 | 17.6 | 76.1 | 6.5 | 9.1 | 1.1 | 67.3 | 3.3 |
| AD-392793 | 72 | 2.1 | 84.9 | 2 | 33 | 3.4 | 68 | 19.8 |
| AD-392757 | 71.3 | 28.8 | 98.5 | 1.7 | 24.4 | 1 | 87.5 | 5.9 |
| AD-392747 | 86.8 | 27.4 | 99.9 | 7.2 | 33.1 | 0.9 | 97.6 | 4.3 |
| AD-392902 | 29.3 | 3.3 | 134.2 | 36.1 | 17.9 | 1.7 | 87 | 6.6 |
| AD-392941 | 36.9 | 13.1 | 82.5 | 5.4 | 13.3 | 1.4 | 70.6 | 13.1 |
| AD-392942 | 22 | 3.6 | 89.2 | 5.2 | 6.5 | 0.8 | 56.2 | 4.4 |
| AD-392943 | 28 | 4.2 | 95.1 | 4.5 | 11.3 | 1.5 | 57 | 6.2 |
| AD-392944 | 27.9 | 3.5 | 85.8 | 4.4 | 12.9 | 0.6 | 53.4 | 4.1 |
| AD-392903 | 16.4 | 1 | 76.8 | 2.7 | 7.9 | 1.1 | 29 | 9.1 |
| AD-392775 | 61.4 | 30.1 | 91.8 | 4.8 | 15 | 0.7 | 85.1 | 5.4 |
| AD-392758 | 53.8 | 35.1 | 83.4 | 8 | 11.1 | 0.9 | 51.6 | 6.6 |
| AD-392945 | 33.3 | 4.7 | 101.9 | 4.9 | 10.6 | 1 | 76.2 | 3.7 |
| AD-392946 | 71 | 6.7 | 99.6 | 3.1 | 39.7 | 2 | 90.3 | 4.5 |
| AD-392884 | 30.2 | 1.9 | 90.5 | 8 | 10.8 | 2.3 | 53.3 | 2.9 |
| AD-392947 | 51.8 | 6 | 95.8 | 1.8 | 12.4 | 0.7 | 68.4 | 3 |
| AD-392748 | 84.5 | 29.8 | 114 | 35.3 | 27.9 | 1.8 | 92.7 | 18.9 |
| AD-392759 | 87.4 | 36.2 | 96.7 | 8.4 | 22.7 | 2.7 | 97 | 7.7 |
| AD-392837 | 37.8 | 0.6 | 91.9 | 4.6 | 7.9 | 2.4 | 36.9 | 1.6 |
| AD-392970 | 84.2 | 7.5 | 93.4 | 4.1 | 7.5 | 1 | 41.3 | 4.2 |
| AD-392976 | 112.8 | 16.8 | 112.7 | 5.3 | 19.8 | 1.4 | 84.1 | 1.7 |
| AD-392965 | 82.2 | 14.1 | 96.1 | 5.9 | 8.2 | 1 | 54.3 | 1.8 |
| AD-392831 | 87.9 | 4.2 | 82 | 12.3 | 12.6 | 2.8 | 55.5 | 5.9 |
| AD-392904 | 74.2 | 2.8 | 105.9 | 7.1 | 26 | 3 | 102.4 | 14.2 |
| AD-392885 | 30.3 | 3.2 | 82.9 | 6 | 5.5 | 1.6 | 29.9 | 3.8 |
| AD-392886 | 26.6 | 3.3 | 87.3 | 2.6 | 9.7 | 2.2 | 40.1 | 4.5 |
| AD-392776 | 60.2 | 17 | 95.7 | 8.6 | 9.4 | 1.5 | 69.4 | 6.5 |
| AD-392887 | 20.8 | 3.3 | 102.3 | 11.9 | 8.1 | 2 | 34.5 | 4.7 |
| AD-392722 | 68.7 | 26.2 | 95.3 | 4.1 | 12.3 | 2.1 | 73.8 | 2.3 |
| AD-392740 | 93.3 | 22.3 | 94.2 | 5.3 | 50.7 | 2.6 | 100.4 | 8.3 |
| AD-392760 | 68.1 | 23 | 96.7 | 5.6 | 8.5 | 0.5 | 57.3 | 5.9 |
| AD-392731 | 39.8 | 10.9 | 99.6 | 12.7 | 4.5 | 2.5 | 41.1 | 11.1 |
| AD-392709 | 74.4 | 24.7 | 107.4 | 13.6 | 11.8 | 0.7 | 78.2 | 5.3 |
| AD-392723 | 58.8 | 23.6 | 119.7 | 22.1 | 14.2 | 3.1 | 72.1 | 3.9 |
| AD-392948 | 32.8 | 7.4 | 84.3 | 2.3 | 6.5 | 0.5 | 33 | 2.3 |
| AD-392724 | 59.7 | 13.5 | 93.8 | 7.2 | 13 | 1.6 | 58.3 | 5.5 |
| AD-392949 | 49 | 2.8 | 92.9 | 2 | 15.8 | 1.7 | 70.8 | 2.6 |
| AD-392725 | 40.2 | 6.5 | 95.7 | 5.9 | 10 | 2.8 | 54.4 | 2.5 |
| AD-392950 | 25.1 | 4.1 | 83.7 | 5.5 | 8.2 | 0.9 | 50.2 | 3.9 |
| AD-392732 | 27.6 | 5.2 | 92.4 | 16.7 | 7.4 | 1.1 | 30.6 | 1.5 |
| AD-392726 | 57.8 | 9.3 | 96 | 4.8 | 9 | 0.6 | 70 | 5.9 |
| AD-392733 | 79.3 | 18 | 92.3 | 5 | 40.3 | 1.9 | 96.6 | 7.5 |
| AD-392906 | 75.4 | 3.6 | 104.5 | 2.1 | 37.2 | 4 | 107 | 18.3 |
| AD-392862 | 33.1 | 2.3 | 84.5 | 4.2 | 10.7 | 2 | 54 | 5.2 |
| AD-392951 | 41 | 6.5 | 94.1 | 8 | 13.4 | 0.5 | 70.5 | 4.1 |
| AD-392871 | 46.6 | 11.3 | 95.8 | 14.3 | 12.2 | 1.8 | 35.7 | 5.2 |
| AD-392872 | 69.6 | 11 | 92 | 7.4 | 17.5 | 3 | 55.4 | 6.7 |
| AD-392952 | 74.8 | 6.9 | 101.1 | 5.8 | 73 | 4.1 | 94.5 | 4.3 |
| AD-392907 | 74.8 | 4.4 | 99.4 | 4.5 | 71.4 | 6.2 | 102.2 | 16.2 |
| AD-392953 | 79.5 | 5.3 | 101.7 | 4.3 | 72.4 | 3.5 | 90.6 | 3.7 |
| AD-392741 | 85 | 16.2 | 93.1 | 4.3 | 90.3 | 5.6 | 97 | 5.7 |
| AD-392908 | 71.7 | 5 | 105.4 | 2.3 | 72.2 | 1.6 | 95 | 9 |
| AD-392977 | 93.7 | 7.9 | 111.3 | 3.2 | 68 | 2.7 | 80.1 | 2.5 |
| AD-392847 | 92.1 | 1.9 | 97.9 | 1.8 | 82.4 | 5 | 85.7 | 8.1 |
| AD-392809 | 93.5 | 7 | 93.9 | 10 | 81.9 | 7.5 | 83.3 | 5.7 |
| AD-392810 | 93 | 6.1 | 88.8 | 5.9 | 76.9 | 5.4 | 90.6 | 2.9 |
| AD-392777 | 88.2 | 20.1 | 92.7 | 7.2 | 86 | 5 | 101.9 | 13 |
| AD-392960 | 85 | 8.7 | 103.7 | 8.7 | 73 | 3.8 | 87 | 6 |
| AD-392873 | 95.5 | 2.9 | 95.5 | 5.6 | 76.4 | 3.7 | 49.1 | 15.4 |
| AD-392889 | 64.1 | 5.5 | 126.2 | 36.5 | 71.1 | 4.8 | 85.6 | 7.4 |
| AD-392954 | 68.9 | 7.2 | 98.1 | 6 | 66.7 | 3.5 | 75.1 | 4.3 |

TABLE 4-continued

APP Single Dose Screen in Primary Cynomolgus Hepatocytes and Be(2)C Cell Line
Data are expressed as percent message remaining relative to AD-1955 non-targeting control.

| Duplex Name | Primary Cynomolgus Hepatocytes | | | | Be(2)C Cell Line | | | |
|---|---|---|---|---|---|---|---|---|
| | 10 nM Avg | 10 nM SD | 0.1 nM Avg | 0.1 nM SD | 10 nM Avg | 10 nM SD | 0.1 nM Avg | 0.1 nM SD |
| AD-392955 | 83 | 3.1 | 98.6 | 5.7 | 73.6 | 1.3 | 88.6 | 2.9 |
| AD-392909 | 61.4 | 4.4 | 101.1 | 5.8 | 67.3 | 4.7 | 85.8 | 10.4 |
| AD-392710 | 110 | 29.8 | 165.2 | 53.6 | 66.7 | 3.8 | 86 | 9.1 |
| AD-392956 | 71.5 | 9.3 | 93.1 | 3.8 | 63.5 | 4.5 | 78.9 | 2.7 |
| AD-392874 | 77.2 | 2.9 | 98.8 | 4.1 | 67.5 | 9.5 | 64.9 | 15.1 |
| AD-392957 | 59.5 | 10.6 | 98.9 | 19 | 60.5 | 4.8 | 72.4 | 2 |
| AD-392958 | 80.4 | 5.5 | 95.9 | 8.2 | 83.3 | 5 | 102.9 | 6.3 |
| AD-392959 | 67.6 | 6.5 | 99 | 6.1 | 75.9 | 3.1 | 89.4 | 3.3 |
| AD-392788 | 106.7 | 6 | 111.9 | 9.1 | 92.1 | 4 | 87.4 | 6.6 |

Certain groups of agents were identified as residing in regions of particularly efficacious APP knockdown targeting. As shown in the above results, some regions of the APP transcript appear to be relatively more susceptible to targeting with RNAi agents of the disclosure than other regions— e.g., the agents that target APP positions 2639 to 2689 in the NM_000484 sequence (i.e., RNAi agents AD-392785, AD-392829, AD-392920, AD-392921, AD-392768, AD-392805, AD-392769, AD-392753, AD-392714, AD-392703 and AD-392715) exhibited particularly robust knockdown results in the Be(2)C cell line, suggesting a possible "hotspot", with likely similar activity of other, overlapping RNAi agents targeting these positions of the APP transcript. It is therefore expressly contemplated that any RNAi agents possessing target sequences that reside fully within the following windows of NM_000484 positions are likely to exhibit robust APP inhibitory effect: APP NM_00484 positions 1891-1919; APP NM_00484 positions 2282-2306; APP NM_00484 positions 2464-2494; APP NM_00484 positions 2475-2638; APP NM_00484 positions 2621-2689; APP NM_00484 positions 2682-2725; APP NM_00484 positions 2705-2746; APP NM_00484 positions 2726-2771; APP NM_00484 positions 2754-2788; APP NM_00484 positions 2782-2813; APP NM_00484 positions 2801-2826; APP NM_00484 positions 2847-2890; APP NM_00484 positions 2871-2896; APP NM_00484 positions 2882-2960; APP NM_00484 positions 2942-2971; APP NM_00484 positions 2951-3057; APP NM_00484 positions 3172-3223; APP NM_00484 positions 3209-3235; NM_00484 positions 3256-3289; NM_00484 positions 3302-3338; APP NM_00484 positions 3318-3353; and APP NM_00484 positions 3334-3361.

TABLE 5A

Mouse APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-397175 | csasugu(Uhd)CfuGf UfGfguaaacucaaL96 | 1403 | VPusUfsgagUfuUfAfccacAfgAfacaugsgsc | 1404 | GCCAUGUUCUGUGGUAAACUCAA | 1405 |
| AD-397176 | usgsuuc(Uhd)GfuGf GfUfaaacucaacaL96 | 1406 | VPusGfsuugAfgUfUfuaccAfcAfgaacasusg | 1407 | CAUGUUCUGUGGUAAACUCAACA | 1408 |
| AD-397177 | asusguu(Chd)UfgUf GfGfuaaacucaaaL96 | 1409 | VPusUfsugaGfuULUfaccaCfaGfaacausgsg | 1410 | CCAUGUUCUGUGGUAAACUCAAC | 1411 |
| AD-397178 | csusgug(Ghd)UfaAf AfCfucaacaugcaL96 | 1412 | VPusGfscauGfuUfGfaguuUfaCfcacagsasa | 1413 | UUCUGUGGUAAACUCAACAUGCA | 1414 |
| AD-397179 | gsgsuaa(Ahd)CfuCf AfAfcaugcacauaL96 | 1415 | VPusAfsuguGfcAfUfguugAfgUfuuaccsasc | 1416 | GUGGUAAACUCAACAUGCACAUG | 1417 |
| AD-397180 | usgsugg(Uhd)AfaAf CfUfcaacaugcaaL96 | 1418 | VPusUfsgcaUfgUfUfgaguUfuAfccacasgsa | 1419 | UCUGUGGUAAACUCAACAUGCAC | 1420 |
| AD-397181 | gsasaga(Ghd)CfaCf UfAfacuugcacgaL96 | 1421 | VPusCfsgugCfaAfGfuuagUfgCfucuucsusc | 1422 | GAGAAGAGCACUAACUUGCACGA | 1423 |
| AD-397182 | cscsgcu(Ghd)GfuAf CfUfuugaugucaaL96 | 1424 | VPusUfsgacAfuCfAfaaguAfcCfagcggsgsa | 1425 | UCCCGCUGGUACUUUGAUGUCAC | 1426 |
| AD-397183 | cscsaug(Uhd)UfcUf GfUfgguaaacucaL96 | 1427 | VPusGfsaguUfuAfCfcacaGfaAfcauggscsg | 1428 | CGCCAUGUUCUGUGGUAAACUCA | 1429 |
| AD-397184 | gsusggu(Ahd)AfaCf UfCfaacaugcacaL96 | 1430 | VPusGfsugcAfuGfUfugagUfuUfaccacsasg | 1431 | CUGUGGUAAACUCAACAUGCACA | 1432 |

TABLE 5A-continued

Mouse APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-397185 | gsasacu(Ghd)CfaGfAfUfcacaaacguaL96 | 1433 | VPusAfscguUfuGfUfgaucUfgCfaguucsasg | 1434 | CUGAACUGCAGAUCACAAACGUG | 1435 |
| AD-397186 | asasgag(Chd)AfcUfAfAfcuugcacgaaL96 | 1436 | VPusUfscguGfcAfAfguuaGfuGfcucuuscsu | 1437 | AGAAGAGCACUAACUUGCACGAC | 1438 |
| AD-397187 | asgscac(Uhd)AfaCfUfUfgcacgacuaaL96 | 1439 | VPusUfsaguCfgUfGfcaagUfuAfgugcuscsu | 1440 | AGAGCACUAACUUGCACGACUAU | 1441 |
| AD-397188 | gscsacu(Ahd)AfcUfUfGfcacgacuauaL96 | 1442 | VPusAfsuagUfcGfUfgcaaGfuUfagugcsusc | 1443 | GAGCACUAACUUGCACGACUAUG | 1444 |
| AD-397189 | asasagu(Uhd)UfaCfUfCfaagacuaccaL96 | 1445 | VPusGfsguaGfuCfUfugagUfaAfacuuusgsg | 1446 | CCAAAGUUUACUCAAGACUACCA | 1447 |
| AD-397190 | csgscau(Ghd)AfaCfCfAfgucucugucaL96 | 1448 | VPusGfsacaGfaGfAfcuggUfuCfaugcgscsu | 1449 | AGCGCAUGAACCAGUCUCUGUCC | 1450 |
| AD-397191 | csascau(Chd)GfuGfAfUfuccuuaccgaL96 | 1451 | VPusCfsgguAfaGfGfaaucAfcGfaugugsgsg | 1452 | CCCACAUCGUGAUUCCUUACCGU | 1453 |
| AD-397192 | asusgcu(Ghd)AfaGfAfAfguacguccgaL96 | 1454 | VPusCfsggaCfgUfAfcuucUfuCfagcausgsu | 1455 | ACAUGCUGAAGAAGUACGUCCGU | 1456 |
| AD-397193 | gsasgcg(Chd)AfuGfAfAfccagucucuaL96 | 1457 | VPusAfsgagAfcUfGfguucAfuGfcgcucsgsu | 1458 | ACGAGCGCAUGAACCAGUCUCUG | 1459 |
| AD-397194 | gsasgca(Ghd)AfaCfUfAfcuccgacgaaL96 | 1460 | VPusUfscguCfgGfAfguagUfuCfugcucscsu | 1461 | AGGAGCAGAACUACUCCGACGAU | 1462 |
| AD-397195 | csasccc(Ahd)CfaUfCfGfugauuccuuaL96 | 1463 | VPusAfsaggAfaUfCfacgaUfgUfgggugsusg | 1464 | CACACCCACAUCGUGAUUCCUUA | 1465 |
| AD-397196 | asgsagc(Ahd)CfuAfAfCfuugcacgacaL96 | 1466 | VPusGfsucgUfgCfAfaguuAfgUfgcucusus | 1467 | GAAGAGCACUAACUUGCACGACU | 1468 |
| AD-397197 | csascua(Ahd)CfuUfGfCfacgacuaugaL96 | 1469 | VPusCfsauaGfuCfGfugcaAfgUfuagugscsu | 1470 | AGCACUAACUUGCACGACUAUGG | 1471 |
| AD-397198 | csuscaa(Ghd)AfcUfAfCfcagugaaccaL96 | 1472 | VPusGfsguuCfaCfUfgguaGfuCfuugagsusa | 1473 | UACUCAAGACUACCAGUGAACCU | 1474 |
| AD-397199 | asgscac(Ahd)CfcCfUfAfaagcauuuaL96 | 1475 | VPusAfsaaaUfgCfUfuuagGfgUfgugcusgsu | 1476 | ACAGCACACCCUAAAGCAUUUUG | 1477 |
| AD-397200 | asasgga(Ghd)CfaGfAfAfcuacuccgaaL96 | 1478 | VPusUfscggAfgUfAfguucUfgCfuccuuscsu | 1479 | AGAAGGAGCAGAACUACUCCGAC | 1480 |
| AD-397201 | gsgsagc(Ahd)GfaAfCfUfacuccgacgaL96 | 1481 | VPusCfsgucGfgAfGfuagLfacUfgcuccsusu | 1482 | AAGGAGCAGAACUACUCCGACGA | 1483 |
| AD-397202 | gsasaac(Ahd)GfuAfCfAfcauccauccaL96 | 1484 | VPusGfsgauGfgAfUfguguAfcUfguuuscsusu | 1485 | AAGAAACAGUACACAUCCAUCCA | 1486 |
| AD-397203 | csusgaa(Chd)UfgCfAfGfaucacaaacaL96 | 1487 | VPusGfsuuuGfuGfAfucugCfaGfuucagsgsg | 1488 | CCCUGAACUGCAGAUCACAAACG | 1489 |
| AD-397204 | cscsaca(Uhd)CfgUfGfAfuuccuuaccaL96 | 1490 | VPusGfsguaAfgGfAfaucaCfgAfugugsgsu | 1491 | ACCCACAUCGUGAUUCCUUACCG | 1492 |
| AD-397205 | gsusgcc(Chd)GfaCfAfAfgugcaaguuaL96 | 1493 | VPusAfsacuUfgCfAfcuugUfcGfggcacsgsa | 1494 | UCGUGCCCGACAAGUGCAAGUUC | 1495 |
| AD-397206 | gsascua(Chd)CfaGfUfGfaaccucuucaL96 | 1496 | VPusGfsaagAfgGfUfucacUfgGfuagucsusu | 1497 | AAGACUACCAGUGAACCUCUUCC | 1498 |
| AD-397207 | gsusccg(Chd)CfaUfCfAfaaaacugguaL96 | 1499 | VPusAfsccaGfuUfUfuugaUfgGfcggacsusu | 1500 | AAGUCCGCCAUCAAAAACUGGUG | 1501 |
| AD-397208 | gsgsccc(Uhd)CfgAfGfAfauuacaucaaL96 | 1502 | VPusUfsgauGfuAfAfuucuCfgAfgggccsasg | 1503 | CUGGCCCUCGAGAAUUACAUCAC | 1504 |
| AD-397209 | csasugc(Uhd)GfaAfGfAfaguacguccaL96 | 1505 | VPusGfsgacGfuAfCfuucuUfcAfgcausgsusu | 1506 | AACAUGCUGAAGAAGUACGUCCG | 1507 |

TABLE 5A-continued

Mouse APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-397210 | usgscug(Ahd)AfgAf AfGfuacguccguaL96 | 1508 | VPusAfscggAfcGfUfacuuCfuUfcagcasusg | 1509 | CAUGCUGAAGAAGUACGUCCGUG | 1510 |
| AD-397211 | uscscgc(Chd)AfuCf AfAfaaacuggugaL96 | 1511 | VPusCfsaccAfgUfUfuuugAfuGfgcggascsu | 1512 | AGUCCGCCAUCAAAAACUGGUGU | 1513 |
| AD-397212 | ususgca(Chd)GfaCf UfAfuggcaugcuaL96 | 1514 | VPusAfsgcaUfgCfCfauagUfcGfugcaasgsu | 1515 | ACUUGCACGACUAUGGCAUGCUG | 1516 |
| AD-397213 | uscscca(Ghd)GfuCf AfUfgagagaaugaL96 | 1517 | VPusCfsauuCfuCfUfcaugAfcCfugggascsa | 1518 | UGUCCCAGGUCAUGAGAGAAUGG | 1519 |
| AD-397214 | csusgaa(Ghd)AfaGf UfAfcguccgugcaL96 | 1520 | VPusGfscacGfgAfCfguacUfuCfuucagscsa | 1521 | UGCUGAAGAAGUACGUCCGUGCG | 1522 |
| AD-397215 | csgsugu(Ghd)AfuCf UfAfcgagcgcauaL96 | 1523 | VPusAfsugcGfcUfCfguagAfuCfacacgsgsa | 1524 | UCCGUGUGAUCUACGAGCGCAUG | 1525 |
| AD-397216 | usascug(Chd)CfaAf GfAfggucuacccaL96 | 1526 | VPusGfsgguAfgAfCfcucuUfgGfcaguascsu | 1527 | AGUACUGCCAAGAGGUCUACCCU | 1528 |
| AD-397217 | csascsg(Chd)GfaGf AfGfaaugucccaaL96 | 1529 | VPusUfsgggAfcAfUfucucUfcUfcggugscsu | 1530 | AGCACCGAGAGAGAAUGUCCCAG | 1531 |
| AD-397218 | csasagg(Chd)CfuCf AfUfcaugaguucaL96 | 1532 | VPusGfsaacAfcAfUfgaugAfgGfccuugsgsg | 1533 | CCCAAGGCCUCAUCAUGUGUUCA | 1534 |
| AD-397219 | gscsuga(Ahd)GfaAf GfUfacguccgugaL96 | 1535 | VPusCfsacgGfaCfGfuacuUfcUfucagcsasu | 1536 | AUGCUGAAGAAGUACGUCCGUGC | 1537 |
| AD-397220 | asasgca(Uhd)UfuUf GfAfacaugugcgaL96 | 1538 | VPusCfsgcaCfaUfGfuucaAfaAfugcuususa | 1539 | UAAAGCAUUUUGAACAUGUGCGC | 1540 |
| AD-397221 | csasccu(Chd)CfgUf GfUfgaucuacgaaL96 | 1541 | VPusUfscguAfgAfUfcacaCfgGfaggugsusg | 1542 | CACACCUCCGUGUGAUCUACGAG | 1543 |
| AD-397222 | gsasagg(Ahd)GfcAf GfAfacuacuccgaL96 | 1544 | VPusCfsggaGfuAfGfuucuGfcUfccuucsusg | 1545 | CAGAAGGAGCAGAACUACUCCGA | 1546 |
| AD-397223 | gsasaga(Ahd)AfcAf GfUfacacauccaaL96 | 1547 | VPusUfsggaUfgUfGfuacuGfuUfucuucsusu | 1548 | AAGAAGAAACAGUACACAUCCAU | 1549 |
| AD-397224 | gsusacu(Ghd)CfcAf AfGfaggucuaccaL96 | 1550 | VPusGfsguaGfaCfCfucuuGfgCfaguacsusg | 1551 | CAGUACUGCCAAGAGGUCUACCC | 1552 |
| AD-397225 | ascsugc(Chd)AfaGf AfGfgucuacccuaL96 | 1553 | VPusAfsgggUfaGfAfccucUfuGfgcagusasc | 1554 | GUACUGCCAAGAGGUCUACCCUG | 1555 |
| AD-397226 | ascsuaa(Chd)UfuGf CfAfcgacuauggaL96 | 1556 | VPusCfscauAfgUfCfgugcAfaGfuuagusgsc | 1557 | GCACUAACUUGCACGACUAUGGC | 1558 |
| AD-397227 | gsusccc(Ahd)UfuCf UfUfuuacggcggaL96 | 1559 | VPusCfscgcCfgUfAfaaagAfaUfgggacsasc | 1560 | GUGUCCCAUUCUUUUACGGCGGA | 1561 |
| AD-397228 | asasgcu(Ghd)AfcAf AfGfaaggccguuaL96 | 1562 | VPusAfsacgGfcCfUfucuuGfuCfagcuususg | 1563 | CAAAGCUGACAAGAAGGCCGUUA | 1564 |
| AD-397229 | usgsaca(Ahd)GfaAf GfGfccguuauccaL96 | 1565 | VPusGfsgauAfaCfGfgccuUfcUfugucasgsc | 1566 | GCUGACAAGAAGGCCGUUAUCCA | 1567 |
| AD-397230 | asgscau(Uhd)UfuGf AfAfcaugugcgcaL96 | 1568 | VPusGfscgcAfcAfUfguucAfaAfaugcususu | 1569 | AAAGCAUUUUGAACAUGUGCGCA | 1570 |
| AD-397231 | usgsuga(Uhd)CfuAf CfGfagcgcaugaaL96 | 1571 | VPusUfscauGfcGfCfucguAfgAfucacascsg | 1572 | CGUGUGAUCUACGAGCGCAUGAA | 1573 |
| AD-397233 | csasgcg(Ahd)GfaAf GfAfgcacuaacuaL96 | 1574 | VPusAfsguuAfgUfGfcucuUfcUfcgcugscsa | 1575 | UGCAGCGAGAAGAGCACUAACUU | 1576 |
| AD-397234 | asgscgu(Ghd)UfcAf AfCfccaaaguuuaL96 | 1577 | VPusAfsaacUfuUfGfgguuGfaCfacgcusgsc | 1578 | GCAGCGUGUCAACCCAAAGUUUA | 1579 |
| AD-397235 | usgsuca(Ahd)CfcCf AfAfaguuuacucaL96 | 1580 | VPusGfsaguAfaAfCfuuugGfgUfugacascsg | 1581 | CGUGUCAACCCAAAGUUUACUCA | 1582 |

TABLE 5A-continued

Mouse APP Modified Sequences

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-397236 | usgsucc(Chd)AfuUfCfUfuuuacggcgaL96 | 1583 | VPusCfsgccGfuAfAagaAfuGfggacascsa | 1584 | UGUGUCCCAUUCUUUUACGGCGG | 1585 |
| AD-397237 | gsusguc(Ahd)AfcCfCfAfaaguuuacuaL96 | 1586 | VPusAfsguaAfaCfUfuuggGfuUfgacacsgsc | 1587 | GCGUGUCAACCCAAAGUUUACUC | 1588 |
| AD-397238 | asasgau(Chd)CfuGfAfUfaaacuucccaL96 | 1589 | VPusGfsggaAfgUfUfuaucAfgGfaucuusgsg | 1590 | CCAAGAUCCUGAUAAACUUCCCA | 1591 |
| AD-397239 | asgsauc(Chd)UfgAfUfAfaacuucccaaL96 | 1592 | VPusUfsgggAfaGfUfuuauCfaGfaucususg | 1593 | CAAGAUCCUGAUAAACUUCCCAC | 1594 |
| AD-397240 | csusuac(Chd)GfuUfGfCfcuaguugguaL96 | 1595 | VPusAfsccaAfcUfAfggcaAfcGfuaagsgsa | 1596 | UCCUUACCGUUGCCUAGUUGGUG | 1597 |
| AD-397241 | gsusgug(Uhd)CfcCfAfUfucuuuuacgaL96 | 1598 | VPusCfsguaAfaAfGfaaugGfgAfcacacsusu | 1599 | AAGUGUGUCCCAUUCUUUUACGG | 1600 |
| AD-397242 | gsusguc(Chd)CfaUfUfCfuuuuacggcaL96 | 1601 | VPusGfsccgUfaAfAfagaaUfgGfgacacsasc | 1602 | GUGUGUCCCAUUCUUUUACGGCG | 1603 |
| AD-397243 | csasuag(Chd)AfaCfCfGfugauugucaaL96 | 1604 | VPusUfsgacAfaUfCfacggUfuGfcuaugsasc | 1605 | GUCAUAGCAACCGUGAUUGUCAU | 1606 |
| AD-397244 | gsasacg(Ghd)AfuUfAfUfGfagaauccaaL96 | 1607 | VPusUfsuggAfuUfCfucauAfuCfguucsusg | 1608 | CAGAACGGAUAUGAGAAUCCAAC | 1609 |
| AD-397245 | usgsugu(Chd)CfcAfUfUfcuuuuacggaL96 | 1610 | VPusCfsscguAfaAfAfgaauGfgGfacacascsu | 1611 | AGUGUGUCCCAUUCUUUUACGGC | 1612 |
| AD-397246 | gscsaac(Chd)GfuGfAfUfugucaucacaL96 | 1613 | VPusGfsugaUfgAfCfaaucAfcGfuugcsusa | 1614 | UAGCAACCGUGAUUGUCAUCACC | 1615 |
| AD-397247 | gscsagc(Chd)AfgAfAfGfagcacuaacaL96 | 1616 | VPusGfsuuaGfuGfCfucuuCfuCfgcugcsasu | 1617 | AUGCAGCGAGAAGAGCACUAACU | 1618 |
| AD-397248 | csasgaa(Uhd)UfcGfGfAfcaugauucaaL96 | 1619 | VPusUfsgaaUfcAfUfguccGfaAfuucugscsa | 1620 | UGCAGAAUUCGGACAUGAUUCAG | 1621 |
| AD-397249 | uscscug(Ahd)UfaAfAfCfuucccacgaaL96 | 1622 | VPusUfscguGfgGfAfaguuUfaUfcaggasusc | 1623 | GAUCCUGAUAAACUUCCCACGAC | 1624 |
| AD-397250 | asgsaac(Ghd)GfaUfAfUfgagaauccaaL96 | 1625 | VPusUfsggaUfuCfUfcauaUfcCfguucusgsc | 1626 | GCAGAACGGAUAUGAGAAUCCAA | 1627 |
| AD-397251 | cscsuua(Chd)CfgUfUfGfccuaguuggaL96 | 1628 | VPusCfscaaCfuAfGfgcaaCfgGfuaaggsasa | 1629 | UUCCUUACCGUUGCCUAGUUGGU | 1630 |
| AD-397252 | asusccu(Ghd)AfuAfAfAfcuucccacgaL96 | 1631 | VPusCfsgugGfgAfAfguuuAfuCfaggauscsu | 1632 | AGAUCCUGAUAAACUUCCCACGA | 1633 |
| AD-397253 | cscsuga(Uhd)AfaAfCfUfucccacgacaL96 | 1634 | VPusGfsucgUfgGfGfaaguUfuAfucaggsasu | 1635 | AUCCUGAUAAACUUCCCACGACA | 1636 |
| AD-397254 | csgsgau(Ghd)GfaUfGfUfuugugagacaL96 | 1637 | VPusGfsucuCfaCfAfaacaUfcCfauccgscsu | 1638 | AGCGGAUGGAUGUUUGUGAGACC | 1639 |
| AD-397255 | gsascac(Ghd)GfaAfGfAfguacugcauaL96 | 1640 | VPusAfsugcAfgGfUfAcucuUfcCfgugucsasa | 1641 | UUGACACGGAAGAGUACUGCAUG | 1642 |
| AD-397256 | gscsagc(Ahd)GfaAfCfGfGfauaugagaaL96 | 1643 | VPusUfscucAfuAfUfccguUfcUfgcugcsasu | 1644 | AUGCAGCAGAACGGAUAUGAGAA | 1645 |
| AD-397257 | gscsaga(Ahd)CfgGfAfUfaucCfgUfucugcsusg | 1646 | VPusCfsauuCfuCfAfuaucCfgUfucugcsusg | 1647 | CAGCAGAACGGAUAUGAGAAUCC | 1648 |
| AD-397258 | csasgaa(Chd)GfgAfUfAfugagaauccaL96 | 1649 | VPusGfsgauUfcUfCfauauCfcGfuucugscsu | 1650 | AGCAGAACGGAUAUGAGAAUCCA | 1651 |
| AD-397259 | ascscgu(Chd)GfcCfAfAfagagacaugaL96 | 1652 | VPusCfsaugUfcUfCfuuugGfcGfacggusgsu | 1653 | ACACCGUCGCCAAAGAGACAUGC | 1654 |
| AD-397260 | gsusucu(Ghd)UfgGfUfAfaacucaacaaL96 | 1655 | VPusUfsguuGfaGfUfuuacCfaCfagaacsasu | 1656 | AUGUUCUGUGGUAAACUCAACAU | 1657 |

TABLE 5A-continued

Mouse APP Modified Sequences

| Duplex Name | Sense Sequence (5' to 3') | SEQ ID NO | Antisense Sequence (5' to 3') | SEQ ID NO | mRNA target sequence | SEQ ID NO |
| --- | --- | --- | --- | --- | --- | --- |
| AD-397261 | gsgsuac(Uhd)UfuGf AfUfgucacugaaaL96 | 1658 | VPusUfsucaGfuGfAfcaucAfaAfguaccsasg | 1659 | CUGGUACUUUGAUGUCACUGAAG | 1660 |
| AD-397262 | cscscaa(Ahd)GfuUf UfAfcucaagacuaL96 | 1661 | VPusAfsgucUfuGfAfguaaAfcUfuugggsusu | 1662 | AACCCAAAGUUUACUCAAGACUA | 1663 |
| AD-397263 | cscsaaa(Ghd)UfuUf AfCfucaagacuaaL96 | 1664 | VPusUfsaguCfuUfGfaguaAfaCfuuuggsgsu | 1665 | ACCCAAAGUUUACUCAAGACUAC | 1666 |
| AD-397264 | csasuca(Uhd)GfuGf UfUfcaacaugcuaL96 | 1667 | VPusAfsgcaUfgUfUfgaacAfcAfugaugsasg | 1668 | CUCAUCAUGUGUUCAACAUGCUG | 1669 |
| AD-397265 | asascau(Ghd)CfuGf AfAfgaaguacguaL96 | 1670 | VPusAfscguAfcUfUfcuucAfgCfauguusgsa | 1671 | UCAACAUGCUGAAGAAGUACGUC | 1672 |
| AD-397266 | ususcug(Uhd)GfgUf AfAfacucaacauaL96 | 1673 | VPusAfsguUfgAfGfuuuaCfcAfcagaascsa | 1674 | UGUUCUGUGGUAAACUCAACAUG | 1675 |
| AD-397267 | uscsugu(Ghd)GfuAf AfAfcucaacaugaL96 | 1676 | VPusCfsaugUfuGfAfguuuAfcCfacagasasc | 1677 | GUUCUGUGGUAAACUCAACAUGC | 1678 |

TABLE 5B

Mouse APP Modified Sequences, No "L96" Linker, No Vinyl-Phosphate

| Duplex Name | Sense Sequence (5' to 3') | SEQ ID NO | Antisense Sequence (5' to 3') | SEQ ID NO | mRNA target sequence | SEQ ID NO |
| --- | --- | --- | --- | --- | --- | --- |
| AD-397175 | csasugu(Uhd)CfuGf UfGfguaaacucaa | 1403 | usUfsgagUfuUfAfccacAfgAfacaugsgsc | 1404 | GCCAUGUUCUGUGGUAAACUCAA | 1405 |
| AD-397176 | usgsuuc(Uhd)GfuGf GfUfaaacucaaca | 1406 | usGfsuugAfgUfUfuaccAfcAfgaacasusg | 1407 | CAUGUUCUGUGGUAAACUCAACA | 1408 |
| AD-397177 | asusguu(Chd)UfgUf GfGfuaaacucaaa | 1409 | usUfsugaGfuUfUfaccaCfaGfaacausgsg | 1410 | CCAUGUUCUGUGGUAAACUCAAC | 1411 |
| AD-397178 | csusgug(Ghd)UfaAf AfCfucaacaugca | 1412 | usGfscauGfuUfGfaguuUfaCfcacagsasa | 1413 | UUCUGUGGUAAACUCAACAUGCA | 1414 |
| AD-397179 | gsgsuaa(Ahd)CfuCf AfAfcaugcacaua | 1415 | usAfsuguGfcAfUfguugAfgUfuuaccsasc | 1416 | GUGGUAAACUCAACAUGCACAUG | 1417 |
| AD-397180 | usgsugg(Uhd)AfaAf CfUfcaacaugcaa | 1418 | usUfsgcaUfgUfUfgaguUfuAfccacasgsa | 1419 | UCUGUGGUAAACUCAACAUGCAC | 1420 |
| AD-397181 | gsasaga(Ghd)CfaCf UfAfacuugcacga | 1421 | usCfsgugCfaAfGfuuagUfgCfucuucsusc | 1422 | GAGAAGAGCACUAACUUGCACGA | 1423 |
| AD-397182 | cscsgcu(Ghd)GfuAf CfUfuugaugucaa | 1424 | usUfsgacAfuCfAfaaguAfcCfagcggsgsa | 1425 | UCCCGCUGGUACUUUGAUGUCAC | 1426 |
| AD-397183 | cscsaug(Uhd)UfcUf GfUfgguaaacuca | 1427 | usGfsaguUfuAfCfcacaGfaAfcauggscsg | 1428 | CGCCAUGUUCUGUGGUAAACUCA | 1429 |
| AD-397184 | gsusggu(Ahd)AfaCf UfCfaacaugcaca | 1430 | usGfsugcAfuGfUfugagUfuUfaccacsasg | 1431 | CUGUGGUAAACUCAACAUGCACA | 1432 |
| AD-397185 | gsasacu(Ghd)CfaGf AfUfcacaaacgua | 1433 | usAfscguUfuGfUfgaucUfgCfaguucsasg | 1434 | CUGAACUGCAGAUCACAAACGUG | 1435 |
| AD-397186 | asasgag(Chd)AfcUf AfAfcuugcacgaa | 1436 | usUfscguGfcAfAfguuaGfuGfcucuuscsu | 1437 | AGAAGAGCACUAACUUGCACGAC | 1438 |
| AD-397187 | asgscac(Uhd)AfaCf UfUfgcacgacuaa | 1439 | usUfsaguCfgUfGfcaagUfuAfgugcuscsu | 1440 | AGAGCACUAACUUGCACGACUAU | 1441 |
| AD-397188 | gscsacu(Ahd)AfcUf UfGfcacgacuaua | 1442 | usAfsuagUfcGfUfgcaaGfuUfagugcsusc | 1443 | GAGCACUAACUUGCACGACUAUG | 1444 |

TABLE 5B-continued

Mouse APP Modified Sequences, No "L96" Linker, No Vinyl-Phosphate

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-397189 | asasagu(Uhd)UfaCf UfCfaagacuacca | 1445 | usGfsguaGfuCfUfugagUfaAfacuuusgsg | 1446 | CCAAAGUUUACUCAAGACUACCA | 1447 |
| AD-397190 | csgscau(Ghd)AfaCf CfAfgucucuguca | 1448 | usGfsacaGfaGfAfcuggUfuCfaugcgscsu | 1449 | AGCGCAUGAACCAGUCUCUGUCC | 1450 |
| AD-397191 | csascau(Chd)GfuGf AfUfuccuuaccga | 1451 | usCfsgguAfaGfGfaaucAfcGfaugugsgsg | 1452 | CCCACAUCGUGAUUCCUUACCGU | 1453 |
| AD-397192 | asusgcu(Ghd)AfaGf AfAfguacguccga | 1454 | usCfsggaCfgUfAfcuucUfcCfagcausgsu | 1455 | ACAUGCUGAAGAAGUACGUCCGU | 1456 |
| AD-397193 | gsasgcg(Chd)AfuGf AfAfccagucucua | 1457 | usAfsgagAfcUfGfguucAfuGfcgcucsgsg | 1458 | ACGAGCGCAUGAACCAGUCUCUG | 1459 |
| AD-397194 | gsasgca(Ghd)AfaCf UfAfcuccgacgaa | 1460 | usUfscguCfgGfAfguagUfcCfugcucscsu | 1461 | AGGAGCAGAACUACUCCGACGAU | 1462 |
| AD-397195 | csasccc(Ahd)CfaUf CfGfugauuccuua | 1463 | usAfsaggAfaUfCfacgaUfgUfgggugsusg | 1464 | CACACCCACAUCGUGAUUCCUUA | 1465 |
| AD-397196 | asgsagc(Ahd)CfuAf AfCfuugcacgaca | 1466 | usGfsucgUfgCfAfaguuAfgUfgcucsusc | 1467 | GAAGAGCACUAACUUGCACGACU | 1468 |
| AD-397197 | csascua(Ahd)CfuUf GfCfacgacauga | 1469 | usCfsauaGfuCfGfugcaAfgUfagugscsu | 1470 | AGCACUAACUUGCACGACUAUGG | 1471 |
| AD-397198 | csuscaa(Ghd)AfcUf AfCfcagugaacca | 1472 | usGfsguuCfaCfUfgguaGfuCfuugagsusa | 1473 | UACUCAAGACUACCAGUGAACCU | 1474 |
| AD-397199 | asgscac(Ahd)CfcCf UfAfaagcauuuua | 1475 | usAfsaaaUfgCfUfuuagGfgUfgugcusgsu | 1476 | ACAGCACACCCUAAAGCAUUUUG | 1477 |
| AD-397200 | asasgga(Ghd)CfaGf AfAfcuacuccgaa | 1478 | usUfscggAfgUfAfguucUfgCfuccuuscsu | 1479 | AGAAGGAGCAGAACUACUCCGAC | 1480 |
| AD-397201 | gsgsagc(Ahd)GfaAf CfUfacuccgacga | 1481 | usCfsgucGfgAfGfuaguUfcUfgcuccsusu | 1482 | AAGGAGCAGAACUACUCCGACGA | 1483 |
| AD-397202 | gsasaac(Ahd)GfuAf CfAfcauccaucca | 1484 | usGfsgauGfgAfUfugugAfcUfguuucsusu | 1485 | AAGAAACAGUACACAUCCAUCCA | 1486 |
| AD-397203 | csusgaa(Chd)UfgCf AfGfaucacaaaca | 1487 | usGfsuuuGfuGfAfucugCfaGfuucagsgsg | 1488 | CCCUGAACUGCAGAUCACAAACG | 1489 |
| AD-397204 | cscsaca(Uhd)CfgUf GfAfuuccuuacca | 1490 | usGfsguaAfgGfAfaucaCfgAfuguggsgsu | 1491 | ACCCACAUCGUGAUUCCUUACCG | 1492 |
| AD-397205 | gsusgcc(Chd)GfaCf AfAfgugcaaguua | 1493 | usAfsacuUfgCfAfcuugUfcGfggcacsgsa | 1494 | UCGUGCCCGACAAGUGCAAGUUC | 1495 |
| AD-397206 | gsascua(Chd)CfaGf UfGfaaccucuuca | 1496 | usGfsaagAfgGfUfucacUfgGfuagucsusu | 1497 | AAGACUACCAGUGAACCUCUUCC | 1498 |
| AD-397207 | gsusccg(Chd)CfaUf CfAfaaaacuggua | 1499 | usAfsccaGfuUfUfuugaUfgGfcggacsusu | 1500 | AAGUCCGCCAUCAAAAACUGGUG | 1501 |
| AD-397208 | gsgsccc(Uhd)CfgAf GfAfauuacaucaa | 1502 | usUfsgauGfuAfAfuucuCfgAfgggccsasg | 1503 | CUGGCCCUCGAGAAUUACAUCAC | 1504 |
| AD-397209 | csasugc(Uhd)GfaAf GfAfaguacgucca | 1505 | usGfsgacGfuAfCfuucuUfcAfgcausu | 1506 | AACAUGCUGAAGAAGUACGUCCG | 1507 |
| AD-397210 | usgscug(Ahd)AfgAf AfGfuacguccgua | 1508 | usAfscggAfcGfUfacuuCfuUfcagcasusg | 1509 | CAUGCUGAAGAAGUACGUCCGUG | 1510 |
| AD-397211 | uscscgc(Chd)AfuCf AfAfaaacugguga | 1511 | usCfsaccAfgUfUfuuugAfuGfcggascsu | 1512 | AGUCCGCCAUCAAAAACUGGUGU | 1513 |
| AD-397212 | ususgca(Chd)GfaCf UfAfuggcaugcua | 1514 | usAfsgcaUfgCfCfauagUfcGfugcaasgsu | 1515 | ACUUGCACGACUAUGGCAUGCUG | 1516 |
| AD-397213 | uscscca(Chd)GfuCf AfUfgagagaauga | 1517 | usCfsauuCfuCfUfcaugAfcCfugggascsa | 1518 | UGUCCCAGGUCAUGAGAGAAUGG | 1519 |

TABLE 5B-continued

Mouse APP Modified Sequences, No "L96" Linker, No Vinyl-Phosphate

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-397214 | csusgaa(Ghd)AfaGf UfAfcguccgugca | 1520 | usGfscacGfgAfCfguacUfuCfuucagscsa | 1521 | UGCUGAAGAAGUACGUCCGUGCG | 1522 |
| AD-397215 | csgsugu(Ghd)AfuCf UfAfcgagcgcaua | 1523 | usAfsugcGfcUfCfguagAfuCfacacgsgsa | 1524 | UCCGUGUGAUCUACGAGCGCAUG | 1525 |
| AD-397216 | usascug(Chd)CfaAf GfAfggucuaccca | 1526 | usGfsgguAfgAfCfcucuUfgGfcaguascsu | 1527 | AGUACUGCCAAGAGGUCUACCCU | 1528 |
| AD-397217 | csasccg(Ahd)GfaGf AfGfaaugucccaa | 1529 | usUfsgggAfcAfUfucucUfcUfcggugscsu | 1530 | AGCACCGAGAGAGAAUGUCCCAG | 1531 |
| AD-397218 | csasagg(Chd)CfuCf AfUfcauguguuca | 1532 | usGfsaacAfcAfUfgaugAfgGfccuugsgsg | 1533 | CCCAAGGCCUCAUCAUGUGUUCA | 1534 |
| AD-397219 | gscsuga(Ahd)GfaAf GfUfacguccguga | 1535 | usCfsacgGfaCfGfuacuUfcUfucagcsasu | 1536 | AUGCUGAAGAAGUACGUCCGUGC | 1537 |
| AD-397220 | asasgca(Uhd)UfuUf GfAfacaugugcga | 1538 | usCfsgcaCfaUfGfuucaAfaAfugcuususa | 1539 | UAAAGCAUUUGAACAUGUGCGC | 1540 |
| AD-397221 | csasccu(Chd)CfgUf GfUfgaucuacgaa | 1541 | usUfscguAfgAfUfcacaCfgGfaggugsusg | 1542 | CACACCUCCGUGUGAUCUACGAG | 1543 |
| AD-397222 | gsasagg(Ahd)GfcAf GfAfacuacuccga | 1544 | usCfsggaGfuAfGfuucuGfcUfccuucsusg | 1545 | CAGAAGGAGCAGAACUACUCCGA | 1546 |
| AD-397223 | gsasaga(Ahd)AfcAf GfUfacacauccaa | 1547 | usUfsggaUfgUfGfuacuGfuUfucuucsusu | 1548 | AAGAAGAAACAGUACACAUCCAU | 1549 |
| AD-397224 | gsusacu(Ghd)CfcAf AfGfaggucuacca | 1550 | usGfsguaGfaCfCfucuuGfcCfaguacsusg | 1551 | CAGUACUGCCAAGAGGUCUACCC | 1552 |
| AD-397225 | ascsugc(Chd)AfaGf AfGfgucuacccua | 1553 | usAfsgggUfaGfAfccucUfuGfcagusasc | 1554 | GUACUGCCAAGAGGUCUACCCUG | 1555 |
| AD-397226 | ascsuaa(Chd)UfuGf CfAfcgacuaugga | 1556 | usCfscauAfgUfCfgugcAfaGfuuagsgsc | 1557 | GCACUAACUUGCACGACUAUGGC | 1558 |
| AD-397227 | gsusccc(Ahd)UfuCf UfUfuuacggcgga | 1559 | usCfscgcCfgUfAfaaagAfaUfgggacsasc | 1560 | GUGUCCCAUUCUUUUACGGCGGA | 1561 |
| AD-397228 | asasgcu(Ghd)AfcAf AfGfaaggccguua | 1562 | usAfsacgGfcCfUfucuuGfuCfagcuususg | 1563 | CAAAGCUGACAAGAAGGCCGUUA | 1564 |
| AD-397229 | usgsaca(Ahd)GfaAf GfGfccguuaucca | 1565 | usGfsgauAfaCfGfgccuUfcUfugucasgsc | 1566 | GCUGACAAGAAGGCCGUUAUCCA | 1567 |
| AD-397230 | asgscau(Uhd)UfuGf AfAfcaugugcgca | 1568 | usGfscgcAfcAfUfguucAfaAfaugcususu | 1569 | AAAGCAUUUGAACAUGUGCGCA | 1570 |
| AD-397231 | usgsuga(Uhd)CfuAf CfGfagcgcaugaa | 1571 | usUfscauGfcGfCfucguAfgAfucacascsg | 1572 | CGUGUGAUCUACGAGCGCAUGAA | 1573 |
| AD-397233 | csasgcg(Ahd)GfaAf GfAfgcacuaacua | 1574 | usAfsguuAfgUfGfcucuUfcUfcgcugscsa | 1575 | UGCAGCGAGAAGAGCACUAACUU | 1576 |
| AD-397234 | asgscgu(Ghd)UfcAf AfCfccaaaguuua | 1577 | usAfsaacUfuUfGfgguuGfaCfacgcgsgsc | 1578 | GCAGCGUGUCAACCCAAAGUUUA | 1579 |
| AD-397235 | usgsuca(Ahd)CfcCf AfAfaguuuacuca | 1580 | usGfsaguAfaAfCfuuugGfgUfugacascsg | 1581 | CGUGUCAACCCAAAGUUUACUCA | 1582 |
| AD-397236 | usgsucc(Ahd)Aftfa CfUfuuuacggcga | 1583 | usCfsgccGfuAfAfaagaAfuGfggacascsa | 1584 | UGUGUCCCAUUCUUUUACGGCGG | 1585 |
| AD-397237 | gsusguc(Ahd)AfcCf CfAfaaguuuacua | 1586 | usAfsguaAfaCfUfuuggGfuUfgacacsgsc | 1587 | GCGUGUCAACCCAAAGUUUACUC | 1588 |
| AD-397238 | asasgau(Chd)CfuGf AfUfaaacuuccca | 1589 | usGfsggaAfgUfUfuaucAfgGfaucuusgsg | 1590 | CCAAGAUCCUGAUAAACUUCCCA | 1591 |
| AD-397239 | asgsauc(Chd)UfgAf UfAfaacuucccaa | 1592 | usUfsgggAfaGfUfuuauCfaGfgaucususg | 1593 | CAAGAUCCUGAUAAACUUCCCAC | 1594 |

TABLE 5B-continued

Mouse APP Modified Sequences, No "L96" Linker, No Vinyl-Phosphate

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-397240 | csusuac(Chd)GfuUf GfCfcuaguuggua | 1595 | usAfsccaAfcUfAfggcaAfcGfguaagsgsa | 1596 | UCCUUACCGUUGCCUAGUUGGUG | 1597 |
| AD-397241 | gsusgug(Uhd)CfcCf AfUfucuuuuacga | 1598 | usCfsguaAfaAfGfaaugGfgAfcacacsusu | 1599 | AAGUGUGUCCCAUUCUUUUACGG | 1600 |
| AD-397242 | gsusguc(Chd)CfaUf UfCfuuuuacggca | 1601 | usGfsccgUfaAfAfagaaUfgGfgacacsasc | 1602 | GUGUGUCCCAUUCUUUUACGGCG | 1603 |
| AD-397243 | csasuag(Chd)AfaCf CfGfugauugucaa | 1604 | usUfsgacAfaUfCfacggUfuGfcuaugsasc | 1605 | GUCAUAGCAACCGUGAUUGUCAU | 1606 |
| AD-397244 | gsasacg(Ghd)AfuAf UfGfagaauccaaa | 1607 | usUfsuggAfuUfCfucauAfuCfcguucsusg | 1608 | CAGAACGGAUAUGAGAAUCCAAC | 1609 |
| AD-397245 | usgsugu(Chd)CfcAf UfUfcuuuuacgga | 1610 | usCfscguAfaAfAfgaauGfgGfacacascsu | 1611 | AGUGUGUCCCAUUCUUUUACGGC | 1612 |
| AD-397246 | gscsaac(Chd)GfuGf AfUfugucaucaca | 1613 | usGfsugaUfgAfCfaaucAfcGfguugcsusa | 1614 | UAGCAACCGUGAUUGUCAUCACC | 1615 |
| AD-397247 | gscsagc(Ghd)AfgAf AfGfagcacuaaca | 1616 | usGfsuuaGfuGfCfucuuCfuCfgcugcsasu | 1617 | AUGCAGCGAGAAGAGCACUAACU | 1618 |
| AD-397248 | csasgaa(Uhd)UfcGf GfAfcaugauucaa | 1619 | usUfsgaaUfcAfUfguccGfaAfuucugscsa | 1620 | UGCAGAAUUCGGACAUGAUUCAG | 1621 |
| AD-397249 | uscscug(Ahd)UfaAf AfCfuucccacgaa | 1622 | usUfscguGfgGfAfaguuUfaUfcaggasusc | 1623 | GAUCCUGAUAAACUUCCCACGAC | 1624 |
| AD-397250 | asgsaac(Ghd)GfaUf AfUfgagaauccaa | 1625 | usUfsggaUfuCfUfcauaUfcCfguucusgsc | 1626 | GCAGAACGGAUAUGAGAAUCCAA | 1627 |
| AD-397251 | cscsuua(Chd)CfgUf UfGfccuaguugga | 1628 | usCfscaaCfuAfGfgcaaCfgGfuaaggsasa | 1629 | UUCCUUACCGUUGCCUAGUUGGU | 1630 |
| AD-397252 | asusccu(Ghd)AfuAf AfAfcuucccacga | 1631 | usCfsgugGfgAfAfguuuAfuCfaggauscsu | 1632 | AGAUCCUGAUAAACUUCCCACGA | 1633 |
| AD-397253 | cscsuga(Uhd)AfaAf CfUfucccacgaca | 1634 | usGfsucgUfgGfGfaaguUfuAfcaggsasu | 1635 | AUCCUGAUAAACUUCCCACGACA | 1636 |
| AD-397254 | csgsgau(Ghd)GfaUf GfUfuugugagaca | 1637 | usGfsucuCfaCfAfaacaUfcCfauccgscsu | 1638 | AGCGGAUGGAUGUUUGUGAGACC | 1639 |
| AD-397255 | gsascac(Ghd)GfaAf GfAfguacugcaua | 1640 | usAfsugcAfgUfAfcucuUfcCfgugucsasa | 1641 | UUGACACGGAAGAGUACUGCAUG | 1642 |
| AD-397256 | gscsagc(Ahd)GfaAf CfGfgauaugagaa | 1643 | usUfscucAfuAfUfccguUfcUfgcugcsasu | 1644 | AUGCAGCAGAACGGAUAUGAGAA | 1645 |
| AD-397257 | gscsaga(Ahd)CfgGf AfUfaugagaauca | 1646 | usGfsauuCfuCfAfuaucCfgUfucugcsusg | 1647 | CAGCAGAACGGAUAUGAGAAUCC | 1648 |
| AD-397258 | csasgaa(Chd)GfgAf UfAfugagaaucca | 1649 | usGfsgauUfcUfCfauauCfcGfuucugscsu | 1650 | AGCAGAACGGAUAUGAGAAUCCA | 1651 |
| AD-397259 | ascscgu(Chd)GfcCf AfAfagagacauga | 1652 | usCfsaugUfcUfCfuuugGfcGfacggusgsu | 1653 | ACACCGUCGCCAAAGAGACAUGC | 1654 |
| AD-397260 | gsusucu(Ghd)UfgGf UfAfaacucaacaa | 1655 | usUfsguuGfaGfUfuuacCfaCfagaacsasu | 1656 | AUGUUCUGUGGUAAACUCAACAU | 1657 |
| AD-397261 | gsgsuac(Uhd)UfuGf AfUfgucacugaaa | 1658 | usUfsucaGfuGfAfcaucAfaAfguaccsasg | 1659 | CUGGUACUUUGAUGUCACUGAAG | 1660 |
| AD-397262 | cscscaa(Ahd)GfuUf UfAfcucaagacua | 1661 | usAfsgucUfuGfAfguaaAfcUfugggsusu | 1662 | AACCCAAAGUUUACUCAAGACUA | 1663 |
| AD-397263 | cscsaaa(Ghd)UfuUf AfCfucaagacuaa | 1664 | usUfsaguCfuUfGfaguaAfaCfuuuggsgsu | 1665 | ACCCAAAGUUUACUCAAGACUAC | 1666 |
| AD-397264 | csasuca(Uhd)GfuGf UfUfcaacaugcua | 1667 | usAfsgcaUfgUfUfgaacAfcAfugaugsasg | 1668 | CUCAUCAUGUGUUCAACAUGCUG | 1669 |

TABLE 5B-continued

Mouse APP Modified Sequences, No "L96" Linker, No Vinyl-Phosphate

| Duplex Name | Sense Sequence (5' to 3') | SEQ ID NO | Antisense Sequence (5' to 3') | SEQ ID NO | mRNA target sequence | SEQ ID NO |
|---|---|---|---|---|---|---|
| AD-397265 | asascau(Ghd)CfuGfAfAfgaaguacgua | 1670 | usAfscguAfcUfUfcuucAfgCfauguusgsa | 1671 | UCAACAUGCUGAAGAAGUACGUC | 1672 |
| AD-397266 | ususcug(Uhd)GfgUfAfAfacucaacaua | 1673 | usAfsuguUfgAfGfuuuaCfcAfcagaascsa | 1674 | UGUUCUGUGGUAAACUCAACAUG | 1675 |
| AD-397267 | uscsugu(Ghd)GfuAfAfAfcucaacauga | 1676 | usCfsaugUfuGfAfguuuAfcCfacagasasc | 1677 | GUUCUGUGGUAAACUCAACAUGC | 1678 |

TABLE 6

APP Unmodified Sequences, Mouse NM_001198823.1 Targeting

| Duplex Name | Sense Sequence (5' to 3') | SEQ ID NO | Position in NM_001198823.1 | Antisense Sequence (5' to 3') | SEQ ID NO | Position in NM_001198823.1 |
|---|---|---|---|---|---|---|
| AD-397183 | CCAUGUUCUGUGGUAAACUCA | 1679 | 253-273 | UGAGUUUACCACAGAACAUGGCG | 1680 | 251-273 |
| AD-397175 | CAUGUUCUGUGGUAAACUCAA | 1681 | 254-274 | UUGAGUUUACCACAGAACAUGGC | 1682 | 252-274 |
| AD-397177 | AUGUUCUGUGGUAAACUCAAA | 1683 | 255-275 | UUUGAGUUUACCACAGAACAUGG | 1684 | 253-275 |
| AD-397176 | UGUUCUGUGGUAAACUCAACA | 1685 | 256-276 | UGUUGAGUUUACCACAGAACAUG | 1686 | 254-276 |
| AD-397260 | GUUCUGUGGUAAACUCAACAA | 1687 | 257-277 | UUGUUGAGUUUACCACAGAACAU | 1688 | 255-277 |
| AD-397266 | UUCUGUGGUAAACUCAACAUA | 1689 | 258-278 | UAUGUUGAGUUUACCACAGAACA | 1690 | 256-278 |
| AD-397267 | UCUGUGGUAAACUCAACAUGA | 1691 | 259-279 | UCAUGUUGAGUUUACCACAGAAC | 1692 | 257-279 |
| AD-397178 | CUGUGGUAAACUCAACAUGCA | 1693 | 260-280 | UGCAUGUUGAGUUUACCACAGAA | 1694 | 258-280 |
| AD-397180 | UGUGGUAAACUCAACAUGCAA | 1695 | 261-281 | UUGCAUGUUGAGUUUACCACAGA | 1696 | 259-281 |
| AD-397184 | GUGGUAAACUCAACAUGCACA | 1697 | 262-282 | UGUGCAUGUUGAGUUUACCACAG | 1698 | 260-282 |
| AD-397179 | GGUAAACUCAACAUGCACAUA | 1699 | 264-284 | UAUGUGCAUGUUGAGUUUACCAC | 1700 | 262-284 |
| AD-397224 | GUACUGCCAAGAGGUCUACCA | 1701 | 362-382 | UGGUAGACCUCUUGGCAGUACUG | 1702 | 360-382 |
| AD-397216 | UACUGCCAAGAGGUCUACCCA | 1703 | 363-383 | UGGGUAGACCUCUUGGCAGUACU | 1704 | 361-383 |
| AD-397225 | ACUGCCAAGAGGUCUACCCUA | 1705 | 364-384 | UAGGGUAGACCUCUUGGCAGUAC | 1706 | 362-384 |
| AD-397203 | CUGAACUGCAGAUCACAAACA | 1707 | 382-402 | UGUUUGUGAUCUGCAGUUCAGGG | 1708 | 380-402 |
| AD-397185 | GAACUGCAGAUCACAAACGUA | 1709 | 384-404 | UACGUUUGUGAUCUGCAGUUCAG | 1710 | 382-404 |
| AD-397195 | CACCCACAUCGUGAUUCCUUA | 1711 | 473-493 | UAAGGAAUCACGAUGUGGGUGUG | 1712 | 471-493 |
| AD-397204 | CCACAUCGUGAUUCCUUACCA | 1713 | 476-496 | UGGUAAGGAAUCACGAUGUGGGU | 1714 | 474-496 |
| AD-397191 | CACAUCGUGAUUCCUUACCGA | 1715 | 477-497 | UCGGUAAGGAAUCACGAUGUGGG | 1716 | 475-497 |
| AD-397251 | CCUUACCGUUGCCUAGUUGGA | 1717 | 489-509 | UCCAACUAGGCAACGGUAAGGAA | 1718 | 487-509 |
| AD-397240 | CUUACCGUUGCCUAGUUGGUA | 1719 | 490-510 | UACCAACUAGGCAACGGUAAGGA | 1720 | 488-510 |
| AD-397205 | GUGCCCGACAAGUGCAAGUUA | 1721 | 534-554 | UAACUUGCACUUGUCGGGCACGA | 1722 | 532-554 |
| AD-397254 | CGGAUGGAUGUUUGUGAGACA | 1723 | 567-587 | UGUCUCACAAACAUCCAUCCGCU | 1724 | 565-587 |
| AD-397259 | ACCGUCGCCAAAGAGACAUGA | 1725 | 603-623 | UCAUGUCUCUUUGGCGACGGUGU | 1726 | 601-623 |
| AD-397247 | GCAGCGAGAAGAGCACUAACA | 1727 | 622-642 | UGUUAGUGCUCUUCUCGCUGCAU | 1728 | 620-642 |
| AD-397233 | CAGCGAGAAGAGCACUAACUA | 1729 | 623-643 | UAGUUAGUGCUCUUCUCGCUGCA | 1730 | 621-643 |
| AD-397181 | GAAGAGCACUAACUUGCACGA | 1731 | 629-649 | UCGUGCAAGUUAGUGCUCUUCUC | 1732 | 627-649 |

TABLE 6-continued

APP Unmodified Sequences, Mouse NM_001198823.1 Targeting

| Duplex Name | Sense Sequence (5' to 3') | SEQ ID NO | Position in NM_001198823.1 | Antisense Sequence (5' to 3') | SEQ ID NO | Position in NM_001198823.1 |
|---|---|---|---|---|---|---|
| AD-397186 | AAGAGCACUAACUUGCACGAA | 1733 | 630-650 | UUCGUGCAAGUUAGUGCUCUUCU | 1734 | 628-650 |
| AD-397196 | AGAGCACUAACUUGCACGACA | 1735 | 631-651 | UGUCGUGCAAGUUAGUGCUCUUC | 1736 | 629-651 |
| AD-397187 | AGCACUAACUUGCACGACUAA | 1737 | 633-653 | UUAGUCGUGCAAGUUAGUGCUCU | 1738 | 631-653 |
| AD-397188 | GCACUAACUUGCACGACUAUA | 1739 | 634-654 | UAUAGUCGUGCAAGUUAGUGCUC | 1740 | 632-654 |
| AD-397197 | CACUAACUUGCACGACUAUGA | 1741 | 635-655 | UCAUAGUCGUGCAAGUUAGUGCU | 1742 | 633-655 |
| AD-397226 | ACUAACUUGCACGACUAUGGA | 1743 | 636-656 | UCCAUAGUCGUGCAAGUUAGUGC | 1744 | 634-656 |
| AD-397212 | UUGCACGACUAUGGCAUGCUA | 1745 | 642-662 | UAGCAUGCCAUAGUCGUGCAAGU | 1746 | 640-662 |
| AD-397182 | CCGCUGGUACUUUGAUGUCAA | 1747 | 1064-1084 | UUGACAUCAAAGUACCAGCGGGA | 1748 | 1062-1084 |
| AD-397261 | GGUACUUUGAUGUCACUGAAA | 1749 | 1069-1089 | UUUCAGUGACAUCAAAGUACCAG | 1750 | 1067-1089 |
| AD-397241 | GUGUGUCCCAUUCUUUUACGA | 1751 | 1094-1114 | UCGUAAAAGAAUGGGACACACUU | 1752 | 1092-1114 |
| AD-397245 | UGUGUCCCAUUCUUUUACGGA | 1753 | 1095-1115 | UCCGUAAAAGAAUGGGACACACU | 1754 | 1093-1115 |
| AD-397242 | GUGUCCCAUUCUUUUACGGCA | 1755 | 1096-1116 | UGCCGUAAAAGAAUGGGACACAC | 1756 | 1094-1116 |
| AD-397236 | UGUCCCAUUCUUUUACGGCGA | 1757 | 1097-1117 | UCGCCGUAAAAGAAUGGGACACA | 1758 | 1095-1117 |
| AD-397227 | GUCCCAUUCUUUUACGGCGGA | 1759 | 1098-1118 | UCCGCCGUAAAAGAAUGGGACAC | 1760 | 1096-1118 |
| AD-397255 | GACACGGAAGAGUACUGCAUA | 1761 | 1143-1163 | UAUGCAGUACUCUUCCGUGUCAA | 1762 | 1141-1163 |
| AD-397234 | AGCGUGUCAACCCAAAGUUUA | 1763 | 1176-1196 | UAAACUUUGGGUUGACACGCUGC | 1764 | 1174-1196 |
| AD-397237 | GUGUCAACCCAAAGUUUACUA | 1765 | 1179-1199 | UAGUAAACUUUGGGUUGACACGC | 1766 | 1177-1199 |
| AD-397235 | UGUCAACCCAAAGUUUACUCA | 1767 | 1180-1200 | UGAGUAAACUUUGGGUUGACACG | 1768 | 1178-1200 |
| AD-397262 | CCCAAAGUUUACUCAAGACUA | 1769 | 1186-1206 | UAGUCUUGAGUAAACUUUGGGUU | 1770 | 1184-1206 |
| AD-397263 | CCAAAGUUUACUCAAGACUAA | 1771 | 1187-1207 | UUAGUCUUGAGUAAACUUUGGGU | 1772 | 1185-1207 |
| AD-397189 | AAAGUUUACUCAAGACUACCA | 1773 | 1189-1209 | UGGUAGUCUUGAGUAAACUUUGG | 1774 | 1187-1209 |
| AD-397198 | CUCAAGACUACCAGUGAACCA | 1775 | 1197-1217 | UGGUUCACUGGUAGUCUUGAGUA | 1776 | 1195-1217 |
| AD-397206 | GACUACCAGUGAACCUCUUCA | 1777 | 1202-1222 | UGAAGAGGUUCACUGGUAGUCUU | 1778 | 1200-1222 |
| AD-397238 | AAGAUCCUGAUAAACUUCCCA | 1779 | 1225-1245 | UGGGAAGUUUAUCAGGAUCUUGG | 1780 | 1223-1245 |
| AD-397239 | AGAUCCUGAUAAACUUCCCAA | 1781 | 1226-1246 | UUGGGAAGUUUAUCAGGAUCUUG | 1782 | 1224-1246 |
| AD-397252 | AUCCUGAUAAACUUCCCACGA | 1783 | 1228-1248 | UCGUGGGAAGUUUAUCAGGAUCU | 1784 | 1226-1248 |
| AD-397249 | UCCUGAUAAACUUCCCACGAA | 1785 | 1229-1249 | UUCGUGGGAAGUUUAUCAGGAUC | 1786 | 1227-1249 |
| AD-397253 | CCUGAUAAACUUCCCACGACA | 1787 | 1230-1250 | UGUCGUGGGAAGUUUAUCAGGAU | 1788 | 1228-1250 |
| AD-397217 | CACCGAGAGAGAAUGUCCCAA | 1789 | 1353-1373 | UUGGGACAUUCUCUCUCGGUGCU | 1790 | 1351-1373 |
| AD-397213 | UCCCAGGUCAUGAGAGAAUGA | 1791 | 1368-1388 | UCAUUCUCUCAUGACCUGGGACA | 1792 | 1366-1388 |
| AD-397228 | AAGCUGACAAGAAGGCCGUUA | 1793 | 1423-1443 | UAACGGCCUUCUUGUCAGCUUUG | 1794 | 1421-1443 |
| AD-397229 | UGACAAGAAGGCCGUUAUCCA | 1795 | 1427-1447 | UGGAUAACGGCCUUCUUGUCAGC | 1796 | 1425-1447 |
| AD-397208 | GGCCCUCGAGAAUUACAUCAA | 1797 | 1562-1582 | UUGAUGUAAUUCUCGAGGGCCAG | 1798 | 1560-1582 |
| AD-397218 | CAAGGCCUCAUCAUGUGUUCA | 1799 | 1603-1623 | UGAACACAUGAUGAGGCCUUGGG | 1800 | 1601-1623 |
| AD-397264 | CAUCAUGUGUUCAACAUGCUA | 1801 | 1611-1631 | UAGCAUGUUGAACACAUGAUGAG | 1802 | 1609-1631 |
| AD-397265 | AACAUGCUGAAGAAGUACGUA | 1803 | 1623-1643 | UACGUACUUCUUCAGCAUGUUGA | 1804 | 1621-1643 |
| AD-397209 | CAUGCUGAAGAAGUACGUCCA | 1805 | 1625-1645 | UGGACGUACUUCUUCAGCAUGUU | 1806 | 1623-1645 |

TABLE 6-continued

APP Unmodified Sequences, Mouse NM_001198823.1 Targeting

| Duplex Name | Sense Sequence (5' to 3') | SEQ ID NO | Position in NM_001198823.1 | Antisense Sequence (5' to 3') | SEQ ID NO | Position in NM_001198823.1 |
|---|---|---|---|---|---|---|
| AD-397192 | AUGCUGAAGAAGUACGUCCGA | 1807 | 1626-1646 | UCGGACGUACUUCUUCAGCAUGU | 1808 | 1624-1646 |
| AD-397210 | UGCUGAAGAAGUACGUCCGUA | 1809 | 1627-1647 | UACGGACGUACUUCUUCAGCAUG | 1810 | 1625-1647 |
| AD-397219 | GCUGAAGAAGUACGUCCGUGA | 1811 | 1628-1648 | UCACGGACGUACUUCUUCAGCAU | 1812 | 1626-1648 |
| AD-397214 | CUGAAGAAGUACGUCCGUGCA | 1813 | 1629-1649 | UGCACGGACGUACUUCUUCAGCA | 1814 | 1627-1649 |
| AD-397199 | AGCACACCCUAAAGCAUUUUA | 1815 | 1666-1686 | UAAAAUGCUUUAGGGUGUGCUGU | 1816 | 1664-1686 |
| AD-397220 | AAGCAUUUUGAACAUGUGCGA | 1817 | 1677-1697 | UCGCACAUGUUCAAAAUGCUUUA | 1818 | 1675-1697 |
| AD-397230 | AGCAUUUUGAACAUGUGCGCA | 1819 | 1678-1698 | UGCGCACAUGUUCAAAAUGCUUU | 1820 | 1676-1698 |
| AD-397221 | CACCUCCGUGUGAUCUACGAA | 1821 | 1746-1766 | UUCGUAGAUCACACGGAGGUGUG | 1822 | 1744-1766 |
| AD-397215 | CGUGUGAUCUACGAGCGCAUA | 1823 | 1752-1772 | UAUGCGCUCGUAGAUCACACGGA | 1824 | 1750-1772 |
| AD-397231 | UGUGAUCUACGAGCGCAUGAA | 1825 | 1754-1774 | UUCAUGCGCUCGUAGAUCACACG | 1826 | 1752-1774 |
| AD-397193 | GAGCGCAUGAACCAGUCUCUA | 1827 | 1764-1784 | UAGAGACUGGUUCAUGCGCUCGU | 1828 | 1762-1784 |
| AD-397190 | CGCAUGAACCAGUCUCUGUCA | 1829 | 1767-1787 | UGACAGAGACUGGUUCAUGCGCU | 1830 | 1765-1787 |
| AD-397222 | GAAGGAGCAGAACUACUCCGA | 1831 | 1850-1870 | UCGGAGUAGUUCUGCUCCUUCUG | 1832 | 1848-1870 |
| AD-397200 | AAGGAGCAGAACUACUCCGAA | 1833 | 1851-1871 | UUCGGAGUAGUUCUGCUCCUUCU | 1834 | 1849-1871 |
| AD-397201 | GGAGCAGAACUACUCCGACGA | 1835 | 1853-1873 | UCGUCGGAGUAGUUCUGCUCCUU | 1836 | 1851-1873 |
| AD-397194 | GAGCAGAACUACUCCGACGAA | 1837 | 1854-1874 | UUCGUCGGAGUAGUUCUGCUCCU | 1838 | 1852-1874 |
| AD-397248 | CAGAAUUCGGACAUGAUUCAA | 1839 | 2167-2187 | UUGAAUCAUGUCCGAAUUCUGCA | 1840 | 2165-2187 |
| AD-397207 | GUCCGCCAUCAAAAACUGGUA | 1841 | 2196-2216 | UACCAGUUUUUGAUGGCGGACUU | 1842 | 2194-2216 |
| AD-397211 | UCCGCCAUCAAAAACUGGUGA | 1843 | 2197-2217 | UCACCAGUUUUUGAUGGCGGACU | 1844 | 2195-2217 |
| AD-397243 | CAUAGCAACCGUGAUUGUCAA | 1845 | 2282-2302 | UUGACAAUCACGGUUGCUAUGAC | 1846 | 2280-2302 |
| AD-397246 | GCAACCGUGAUUGUCAUCACA | 1847 | 2286-2306 | UGUGAUGACAAUCACGGUUGCUA | 1848 | 2284-2306 |
| AD-397223 | GAAGAAACAGUACACAUCCAA | 1849 | 2321-2341 | UUGGAUGUGUACUGUUUCUUCUU | 1850 | 2319-2341 |
| AD-397202 | GAAACAGUACACAUCCAUCCA | 1851 | 2324-2344 | UGGAUGGAUGUGUACUGUUUCUU | 1852 | 2322-2344 |
| AD-397256 | GCAGCAGAACGGAUAUGAGAA | 1853 | 2405-2425 | UUCUCAUAUCCGUUCUGCUGCAU | 1854 | 2403-2425 |
| AD-397257 | GCAGAACGGAUAUGAGAAUCA | 1855 | 2408-2428 | UGAUUCUCAUAUCCGUUCUGCUG | 1856 | 2406-2428 |
| AD-397258 | CAGAACGGAUAUGAGAAUCCA | 1857 | 2409-2429 | UGGAUUCUCAUAUCCGUUCUGCU | 1858 | 2407-2429 |
| AD-397250 | AGAACGGAUAUGAGAAUCCAA | 1859 | 2410-2430 | UUGGAUUCUCAUAUCCGUUCUGC | 1860 | 2408-2430 |
| AD-397244 | GAACGGAUAUGAGAAUCCAAA | 1861 | 2411-2431 | UUUGGAUUCUCAUAUCCGUUCUG | 1862 | 2409-2431 |

TABLE 7

APP Single Dose Screen in Primary Mouse Hepatocytes and Neuro2A Cell Line Data are expressed as percent message remaining relative to AD-1955 non-targeting control.

| | Primary Mouse Hepatocytes | | | | Neuro2A Cell Line | | | |
|---|---|---|---|---|---|---|---|---|
| Duplex Name | 10 nM Avg | 10 nM SD | 0.1 nM Avg | 0.1 nM SD | 10 nM Avg | 10 nM SD | 0.1 nM Avg | 0.1 nM SD |
| AD-397183 | 4.2 | 1.4 | 37.3 | 24.3 | 7.94 | 2.86 | 52.66 | 5.87 |
| AD-397175 | 1.6 | 0.7 | 4.7 | 1.3 | 0.75 | 0.32 | 29.72 | 6.47 |
| AD-397177 | 1.3 | 1.1 | 3.9 | 2.6 | 0.4 | 0.13 | 18.06 | 3.73 |
| AD-397176 | 1.5 | 0.5 | 35.1 | 11.3 | 4.7 | 1.45 | 69.36 | 7.89 |
| AD-397260 | 11.2 | 1.5 | 73.4 | 23.1 | 20.53 | 3.62 | 81.33 | 2.21 |

TABLE 7-continued

APP Single Dose Screen in Primary Mouse Hepatocytes and Neuro2A Cell Line Data are expressed as percent message remaining relative to AD-1955 non-targeting control.

| | Primary Mouse Hepatocytes | | | | Neuro2A Cell Line | | | |
|---|---|---|---|---|---|---|---|---|
| Duplex Name | 10 nM Avg | 10 nM SD | 0.1 nM Avg | 0.1 nM SD | 10 nM Avg | 10 nM SD | 0.1 nM Avg | 0.1 nM SD |
| AD-397266 | 2.8 | 2 | 65.1 | 4.5 | 4.35 | 0.58 | 73.16 | 8.45 |
| AD-397267 | 0.8 | 0.3 | 23.6 | 4.2 | 1.18 | 0.28 | 37.78 | 3.45 |
| AD-397178 | 5.1 | 4.1 | 33.3 | 6.1 | 1.8 | 0.38 | 54.61 | 3.11 |
| AD-397180 | 1.3 | 0.4 | 28 | 13.9 | 0.47 | 0.06 | 37.8 | 3.96 |
| AD-397184 | 15.7 | 8.9 | 67.8 | 13.5 | 8.86 | 2.55 | 87.82 | 5.6 |
| AD-397179 | 5.7 | 1.6 | 45.1 | 26 | 3.12 | 0.86 | 57.24 | 5.19 |
| AD-397224 | 52.9 | 18.5 | 63.8 | 10.6 | 17.15 | 2.47 | 67.99 | 7.6 |
| AD-397216 | 25.6 | 17.9 | 104.2 | 21.6 | 34.91 | 7.44 | 98.89 | 4.08 |
| AD-397225 | 45.1 | 21.9 | 60.8 | 13.7 | 9.72 | 5.52 | 63.44 | 7.19 |
| AD-397203 | 3.3 | 1.6 | 71.9 | 8.2 | 5.1 | 0.98 | 75.87 | 3.29 |
| AD-397185 | 4.9 | 2.1 | 40.3 | 8.1 | 2.7 | 0.35 | 61.49 | 8.12 |
| AD-397195 | 2.5 | 1.3 | 49.8 | 21.8 | 1.64 | 0.08 | 63.95 | 5.83 |
| AD-397204 | 8.3 | 2 | 68 | 10.7 | 4.37 | 0.89 | 50.83 | 7.41 |
| AD-397191 | 1.5 | 0.5 | 39.9 | 14.8 | 1.5 | 1.06 | 55.07 | 10.78 |
| AD-397251 | 7.8 | 1.7 | 91.7 | 5.7 | 3.86 | 2.5 | 84.36 | 6.5 |
| AD-397240 | 4.2 | 1.9 | 61.9 | 6.8 | 2.48 | 0.7 | 62.39 | 1.48 |
| AD-397205 | 13.5 | 10.5 | 86 | 11.4 | 13.06 | 7.61 | 76.77 | 2.64 |
| AD-397254 | 1.9 | 1.1 | 27.6 | 24.3 | 3.77 | 2.77 | 57.26 | 14.42 |
| AD-397259 | 3.5 | 0.7 | 79 | 22.8 | 9.43 | 1.12 | 82.49 | 3.19 |
| AD-397247 | 5.5 | 1 | 90.4 | 16.9 | 10.95 | 2.85 | 94.95 | 4.55 |
| AD-397233 | 6.7 | 6.2 | 84.4 | 10.3 | 3.4 | 1.14 | 76.36 | 4.66 |
| AD-397181 | 4.7 | 0.9 | 60.5 | 25.2 | 6.28 | 2.17 | 62.62 | 3.59 |
| AD-397186 | 53 | 17 | 82 | 14.7 | 42.07 | 9.63 | 95.63 | 6.67 |
| AD-397196 | 1.9 | 0.4 | 40.9 | 11.3 | 4.66 | 4.19 | 56.2 | 1.82 |
| AD-397187 | 28.4 | 11.2 | 77.5 | 13.3 | 25.64 | 8.56 | 86.64 | 5.99 |
| AD-397188 | 65.1 | 15.9 | 76.2 | 20 | 43.32 | 13.51 | 84.69 | 5.63 |
| AD-397197 | 2 | 1 | 41.9 | 10.7 | 2.11 | 0.41 | 55.63 | 2.15 |
| AD-397226 | 10.3 | 4.3 | 30 | 5 | 0.69 | 0.43 | 47.42 | 5.33 |
| AD-397212 | 1.8 | 0.1 | 65.4 | 9.3 | 1.94 | 0.48 | 63 | 29.9 |
| AD-397182 | 2.1 | 0.6 | 11.3 | 5.3 | 12.2 | 3.42 | 35.13 | 6.78 |
| AD-397261 | 2.3 | 0.6 | 32.6 | 10 | 29.93 | 2.71 | 48.28 | 24.73 |
| AD-397241 | 23 | 3.5 | 102.7 | 13.3 | 41.16 | 4.58 | 92.7 | 5.11 |
| AD-397245 | 60.9 | 8.6 | 60.9 | 14.3 | 55.71 | 4.45 | 68.27 | 6.83 |
| AD-397242 | 5.6 | 1.1 | 90.5 | 16.2 | 30.83 | 2.94 | 85.43 | 4.05 |
| AD-397236 | 16.9 | 6.2 | 71.9 | 5.7 | 32.58 | 2.93 | 67.13 | 3.06 |
| AD-397227 | 48.7 | 29.8 | 50.5 | 19.4 | 19.55 | 9.28 | 59.59 | 3.24 |
| AD-397255 | 6.1 | 0.8 | 73.8 | 33 | 24.01 | 5 | 86.3 | 9.24 |
| AD-397234 | 100.3 | 39.9 | 93.7 | 7.8 | 51.88 | 13.54 | 80.77 | 2.1 |
| AD-397237 | 36.2 | 28.6 | 49.5 | 14 | 32.83 | 17.93 | 51.76 | 10.71 |
| AD-397235 | 58 | 20.9 | 76.2 | 8 | 41.15 | 19.69 | 73.72 | 6 |
| AD-397262 | 22.1 | 6.9 | 51.8 | 16.2 | 61.74 | 5.34 | 65.6 | 14.12 |
| AD-397263 | 19.9 | 8 | 57.9 | 6.1 | 59.09 | 7.38 | 82.09 | 11.31 |
| AD-397189 | 17 | 5.1 | 56.2 | 9.5 | 49.48 | 18.93 | 73.89 | 5.4 |
| AD-397198 | 19.8 | 2.4 | 38.8 | 9.1 | 50.52 | 28.37 | 62.16 | 9.56 |
| AD-397206 | 18.8 | 1.7 | 41 | 12.6 | 62.65 | 21.77 | 61.59 | 8.42 |
| AD-397238 | 16.3 | 2 | 61.5 | 27.8 | 71.66 | 9.3 | 86.52 | 7.97 |
| AD-397239 | 34.6 | 11.4 | 101 | 22.8 | 74.11 | 7.37 | 91.24 | 4.34 |
| AD-397252 | 23.1 | 7.5 | 93.8 | 3.1 | 55.54 | 4.89 | 75.74 | 5.31 |
| AD-397249 | 35.6 | 4 | 104.9 | 10.9 | 70.19 | 3.96 | 97.86 | 6.43 |
| AD-397253 | 29.6 | 5.5 | 44.6 | 19.2 | 66.41 | 8.65 | 66.4 | 6.46 |
| AD-397217 | 11.5 | 6.3 | 102.4 | 20.9 | 18.85 | 3.87 | 98.69 | 3.04 |
| AD-397213 | 7.3 | 1.9 | 79.4 | 21.9 | 10.91 | 2.81 | 87.03 | 4.86 |
| AD-397228 | 68.7 | 66.7 | 43.2 | 9.3 | 23.79 | 8.45 | 53.36 | 3.55 |
| AD-397229 | 3.9 | 0.3 | 15.8 | 9.4 | 1.67 | 1.35 | 31.6 | 5.21 |
| AD-397208 | 18.2 | 3.9 | 96.2 | 27.2 | 37.55 | 9.28 | 97.91 | 5.09 |
| AD-397218 | 35 | 14.6 | 106 | 20.7 | 30.88 | 7.34 | 101.82 | 3.13 |
| AD-397264 | 4.2 | 2.2 | 98 | 12.9 | 19.97 | 2.06 | 104.79 | 4.61 |
| AD-397265 | 3 | 2.3 | 81.2 | 7.8 | 5.98 | 4.03 | 84.1 | 8.97 |
| AD-397209 | 10.9 | 9.3 | 90.5 | 22.2 | 17.18 | 3.16 | 81.66 | 5.17 |
| AD-397192 | 4.7 | 1.8 | 80.6 | 13 | 6.51 | 1.99 | 95.04 | 4.22 |
| AD-397210 | 22.6 | 6.4 | 83.6 | 24.7 | 6.55 | 1.38 | 82.6 | 3.83 |
| AD-397219 | 10.2 | 3.6 | 101.8 | 21.8 | 16.76 | 3.62 | 87.34 | 4.87 |
| AD-397214 | 5.8 | 0.9 | 34.4 | 14.3 | 12.78 | 5.24 | 54.95 | 18.66 |
| AD-397199 | 62.2 | 14.3 | 63.4 | 35 | 87.69 | 22.23 | 85.84 | 4.93 |
| AD-397220 | 5.2 | 0.5 | 99.2 | 18.2 | 5.91 | 1.12 | 91.13 | 2.97 |
| AD-397230 | 6.3 | 3.9 | 61.5 | 23.1 | 5.51 | 3.99 | 77.38 | 3.26 |
| AD-397221 | 10.5 | 3.4 | 111.2 | 42.5 | 24.53 | 4.87 | 93.86 | 3.22 |
| AD-397215 | 14.3 | 2.9 | 80.7 | 40 | 44.04 | 14.01 | 91.83 | 10.03 |
| AD-397231 | 17.1 | 3.2 | 108.7 | 19.6 | 21.54 | 1.56 | 79.31 | 4.22 |
| AD-397193 | 3.3 | 0.3 | 93.1 | 21.6 | 12.76 | 1.97 | 93.03 | 6.46 |
| AD-397190 | 2.7 | 0.5 | 27.8 | 13.5 | 3.63 | 2.79 | 45.56 | 7.21 |
| AD-397222 | 62.9 | 9.1 | 57.2 | 17 | 25.04 | 11.48 | 80.41 | 4.04 |

TABLE 7-continued

APP Single Dose Screen in Primary Mouse Hepatocytes and Neuro2A Cell Line Data are expressed as percent message remaining relative to AD-1955 non-targeting control.

|  | Primary Mouse Hepatocytes | | | | Neuro2A Cell Line | | | |
| --- | --- | --- | --- | --- | --- | --- | --- | --- |
| Duplex Name | 10 nM Avg | 10 nM SD | 0.1 nM Avg | 0.1 nM SD | 10 nM Avg | 10 nM SD | 0.1 nM Avg | 0.1 nM SD |
| AD-397200 | 8.6 | 8.2 | 89.6 | 18.6 | 9.63 | 1.79 | 88.31 | 6.27 |
| AD-397201 | 85.2 | 40.7 | 106 | 17.5 | 41.76 | 9.95 | 105.41 | 3.36 |
| AD-397194 | 35.4 | 12.2 | 92 | 8.3 | 51.26 | 11.38 | 107.07 | 3.23 |
| AD-397248 | 7.8 | 1.1 | 97.5 | 17.7 | 17.64 | 1.67 | 103.37 | 4.94 |
| AD-397207 | 6.9 | 4 | 59.5 | 39.1 | 6.28 | 2.65 | 82.18 | 8.76 |
| AD-397211 | 18.2 | 8.6 | 101.1 | 20.6 | 14.71 | 4.06 | 96.99 | 2.56 |
| AD-397243 | 2.2 | 1.5 | 63.1 | 11.2 | 0.6 | 0.32 | 55.57 | 2.17 |
| AD-397246 | 1.5 | 0.6 | 46.6 | 22.5 | 0.86 | 0.64 | 63.09 | 3.39 |
| AD-397223 | 46.8 | 15.8 | 63.3 | 17.2 | 9.73 | 2.48 | 73.44 | 2.51 |
| AD-397202 | 32.5 | 7.6 | 103.4 | 25.9 | 20.68 | 4.37 | 95.57 | 5.11 |
| AD-397256 | 2.1 | 0.7 | 71.4 | 8 | 1.77 | 1.21 | 79.93 | 1.89 |
| AD-397257 | 2.4 | 0.7 | 76.1 | 23.3 | 5.45 | 2.7 | 84.43 | 7.45 |
| AD-397258 | 0.9 | 0.1 | 45.4 | 8.3 | 0.63 | 0.4 | 55.81 | 5.17 |
| AD-397250 | 0.8 | 0.1 | 54.9 | 11.3 | 0.52 | 0.23 | 46.87 | 3.19 |
| AD-397244 | 2.2 | 1.2 | 74.2 | 12 | 1.87 | 1.87 | 67.15 | 3.5 |

As noted for Table 4 above, it is expressly contemplated that any RNAi agents possessing target sequences that reside fully within the following windows of NM_001198823.1 positions are likely to exhibit robust APP inhibitory effect: APP NM_001198823.1 positions 251-284; APP NM_001198823.1 positions 362-404; APP NM_001198823.1 positions 471-510; APP NM_001198823.1 positions 532-587; APP NM_001198823.1 positions 601-649; APP NM_001198823.1 positions 633-662; APP NM_001198823.1 positions 1351-1388; APP NM_001198823.1 positions 1609-1649; APP NM_001198823.1 positions 1675-1698; APP NM_001198823.1 positions 1752-1787; APP NM_001198823.1 positions 2165-2217; APP NM_001198823.1 positions 2280-2344; and APP NM_001198823.1 positions 2403-2431.

Example 2. In Vivo Evaluation of RNAi Agents

Figure 1B:
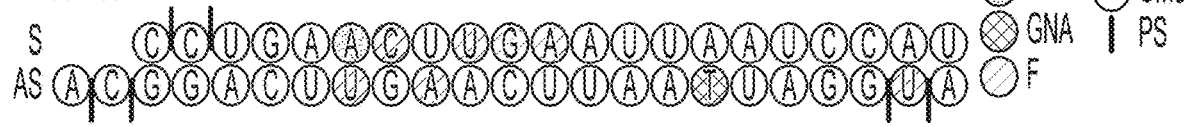
Figure 1B:
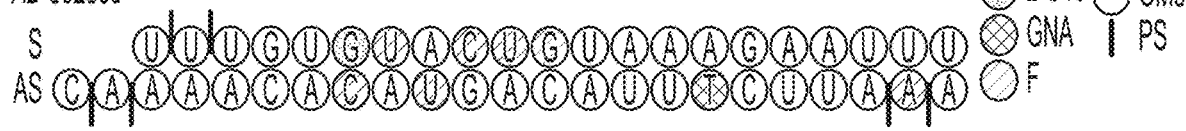
Figure 1B:
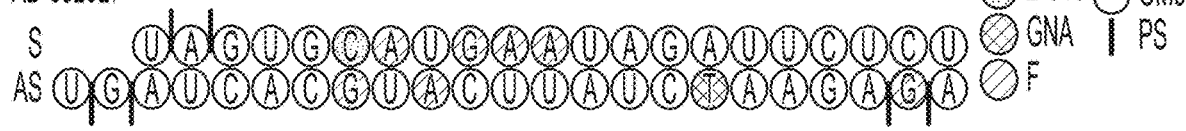
Figure 1B:
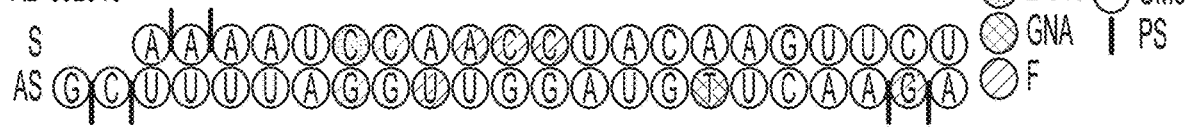
Figure 1B:
Figure 1B:
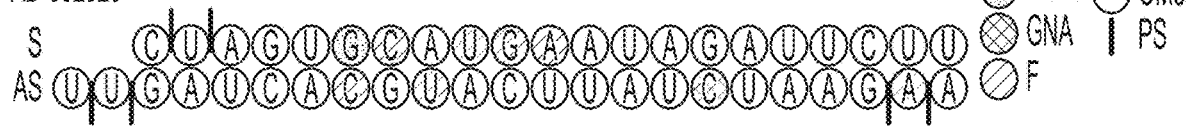

Selected APP-targeting RNAi agents were evaluated for in vivo efficacy in respective proof of concept and lead identification screens for human APP knockdown in AAV mice. The selected RNAi agents for such studies included AD-392911, AD-392912, AD-392911, AD-392912, AD-392913, AD-392843, AD-392844, AD-392824, AD-392704, AD-392790, AD-392703, AD-392866, AD-392927, AD-392916, AD-392714 and AD-392926, having sequences as recited in Table 2A above, corresponding unmodified sequences as shown in Table 3 above, and as graphically depicted in FIG. 1A and FIG. 1B, with each RNAi agent tested in the instant Example further presenting a triantennary GalNAc moiety attached at the 3' residue of the sense strand, for purpose of aiding liver targeting of such RNAi agents when administered subcutaneously to mice (for intrathecal administration, agents lacking a conjugated GalNAc moiety are expressly contemplated).

In such studies, an AAV vector harboring Homo sapiens APP was intravenously injected to 6-8 week old C57BL/6 female mice, and at 14 days post-AAV administration, a selected RNAi agent or a control agent were subcutaneously injected at 3 mg/kg to mice (n=3 per group), with mice sacrificed and livers assessed for APP mRNA levels at 14 days post-subcutaneous injection of RNAi agent or control.

Figure 2A:
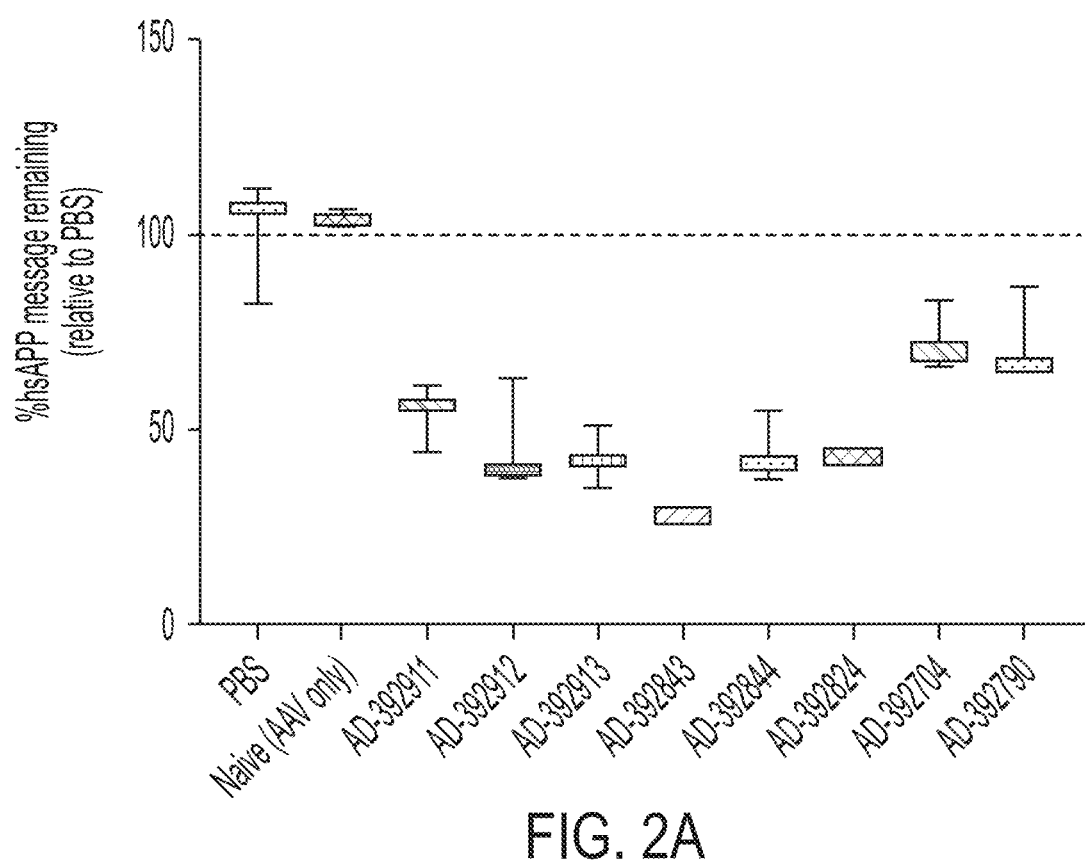
FIG. 2A and FIG. 2B show in vivo hsAPP knockdown activity results observed for the modified RNAi agents shown in FIG. 1A and FIG. 1B.
Figure 2B:
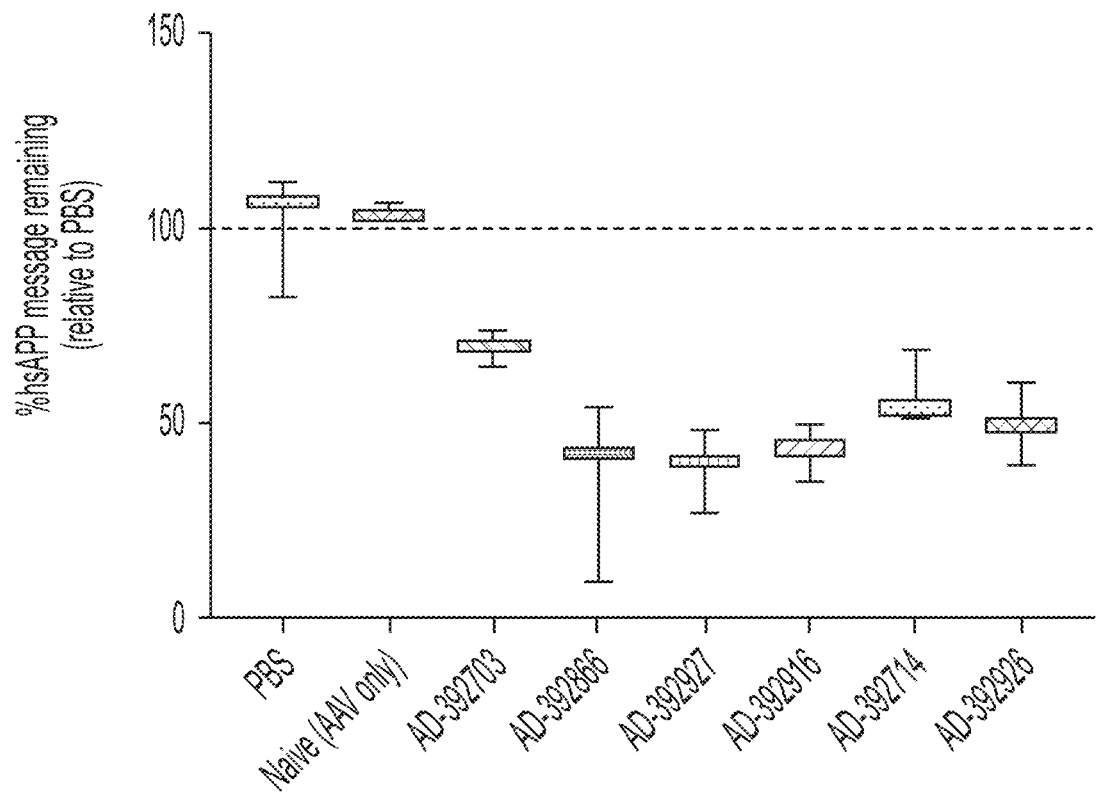

Significant levels of in vivo human APP mRNA knockdown in liver were observed for all RNAi agents tested, as compared to PBS and Naïve (AAV only) controls, with particularly robust levels of knockdown observed, e.g., for AD-392911, AD-392912, AD-392911, AD-392912, AD-392913, AD-392843, AD-392844, AD-392824, AD-392866, AD-392927, AD-392916, AD-392714 and AD-392926 (FIG. 2A and FIG. 2B). Results used to generate FIG. 2A and FIG. 2B are tabulated in below Table 8.

TABLE 8 hsAPP In Vivo Knockdown Screen Results (3 mg/kg, day 14, liver)

| Treatment | % message remaining | stdev |
| --- | --- | --- |
| PBS | 100.00 | 15.77 |
| naïve (AAV-only) | 104.17 | 1.89 |
| AD-392911 | 53.75 | 8.76 |
| AD-392912 | 46.47 | 14.18 |
| AD-392913 | 42.34 | 7.95 |
| AD-392843 | 27.25 | 0.46 |
| AD-392844 | 44.25 | 9.04 |
| AD-392824 | 42.64 | 0.87 |
| AD-392704 | 72.99 | 8.76 |
| AD-392790 | 72.71 | 11.66 |
| AD-392703 | 69.60 | 4.70 |
| AD-392866 | 35.94 | 23.08 |
| AD-392927 | 38.91 | 10.60 |
| AD-392916 | 43.27 | 7.17 |
| AD-392714 | 58.08 | 9.55 |
| AD-392926 | 50.26 | 10.29 |

Example 3: Identification of Potent Human APP siRNAs Against Hereditary Cerebral Amyloid Angiopathy (hCAA)

Hereditary cerebral amyloid angiopathy (hCAA) is driven by autosomal dominant mutations in the gene encoding Amyloid Precursor Protein (APP) (Van Etten et al. 2016 Neurology). In the disease, neuron-derived beta amyloid is deposited in vasculature causing significant structural alterations and a distinctive double barreling of vessels. hCAA appears to be a relatively pure angiopathy with minimal presence of parenchymal plaques or tau tangles (Natte et al.

2012 *Annals of Neurology*). Ultimately, increased deposition of amyloid beta leads to microhemorrhages, dementia and stroke. hCAA is a rapidly progressing disease with life expectancy of 7-10 years following symptom onset (Charidimou A et al. *J Neurol Neurosurg Psychiatry* 2012; 83: 124-137). As noted herein, there are currently no disease-modifying therapies available. In the instant disclosure, combining stable siRNA designs with alternative conjugation strategies provided potent, long-lasting silencing across the CNS following a single intrathecal administration with 95% target knockdown observed out to three months.

Be(2)C Cell Screening and In Vivo Liver Based Screens

Figure 3A:
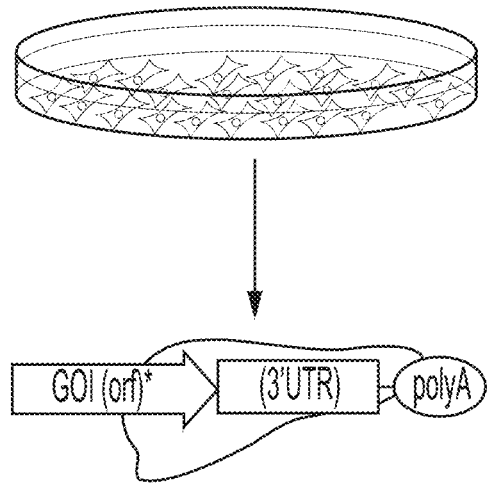
FIG. 3A is a scheme demonstrating the strategy to identify potent human APP (hAPP) siRNAs in targeting hereditary cerebral amyloid angiopathy (hCAA).
Figure 3B:
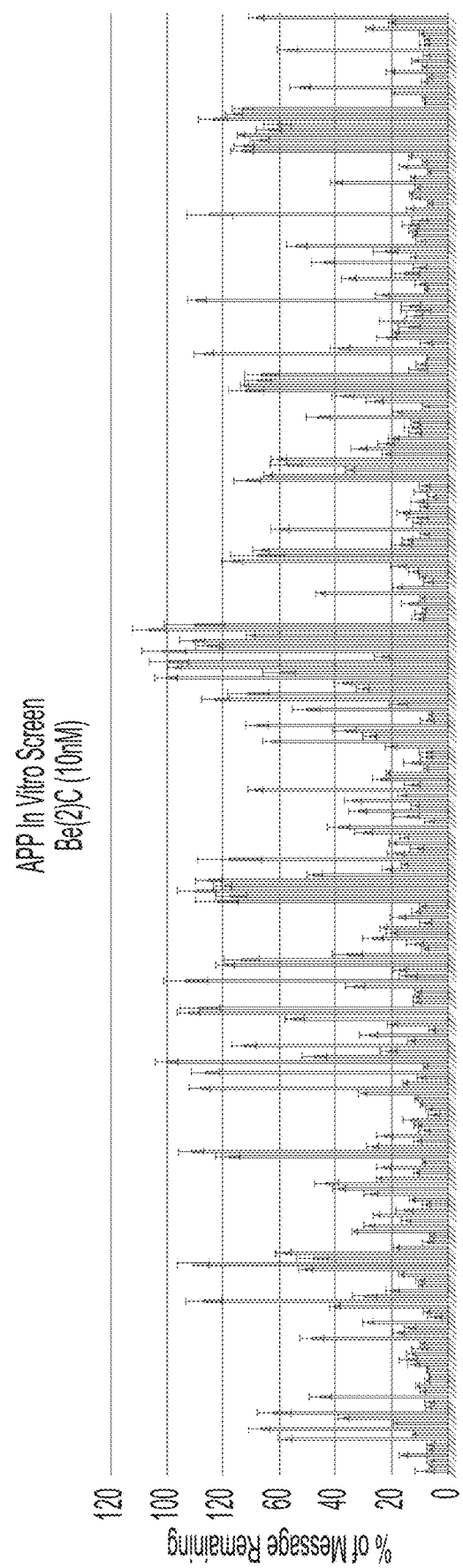
FIG. 3B is a plot of percent remaining mRNA in an in vitro endogenous screen of hAPP siRNAs at a concentration of 10 nM in Be(2)C cells.

To identify potent hAPP siRNAs, siRNAs were first screened in vitro in Be(2)C cells. As shown in FIG. 3A and FIG. 3B, over 300 siRNAs were transfected into Be(2)C cells at concentrations of 10 nM (FIG. 3B) and 0.1 nM (data not shown) and the percent remaining mRNA was assayed by qPCR. In vivo liver based AAV-hAPP screening was then performed in mice in order to identify compounds capable of knocking down human APP. GalNAc APP siRNAs designed against either hAPP ORF or hAPP 3' UTR were administered subcutaneously at 3 mg/kg (as shown in FIGS. 2A and 2B, respectively). A selected subset of compounds was then converted to CNS conjugates and used in both non-human primate lead finding studies and in rodent models of disease using intrathecal (IT) administration. As noted above, particularly robust levels of knockdown were observed for, e.g., AD-392911, AD-392912, AD-392911, AD-392912, AD-392913, AD-392843, AD-392844, AD-392824, AD-392866, AD-392927, AD-392916, AD-392714 and AD-392926 (FIG. 2A and FIG. 2B).

Figure 4A:
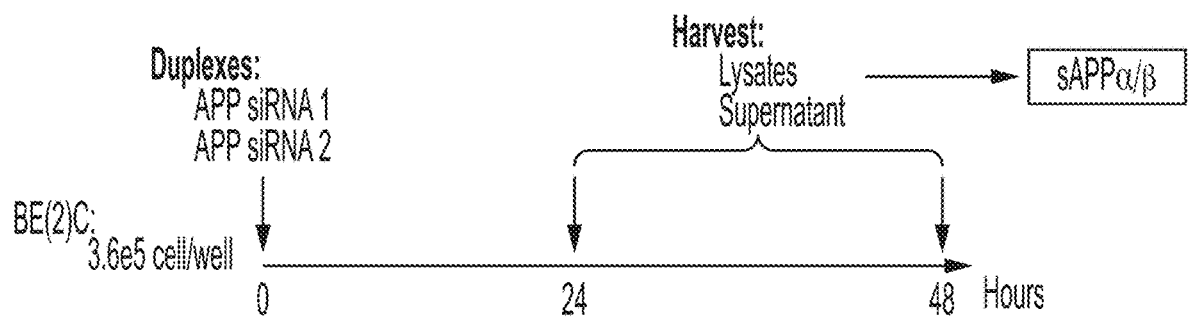
FIG. 4A is a scheme demonstrating the timing of APP siRNA transfection in BE(2)C neuronal cells. APP siRNA was transfected at 10, 1, and 0.1 nM and assessed 24 and 48 hours after transfection.
Figure 4B:
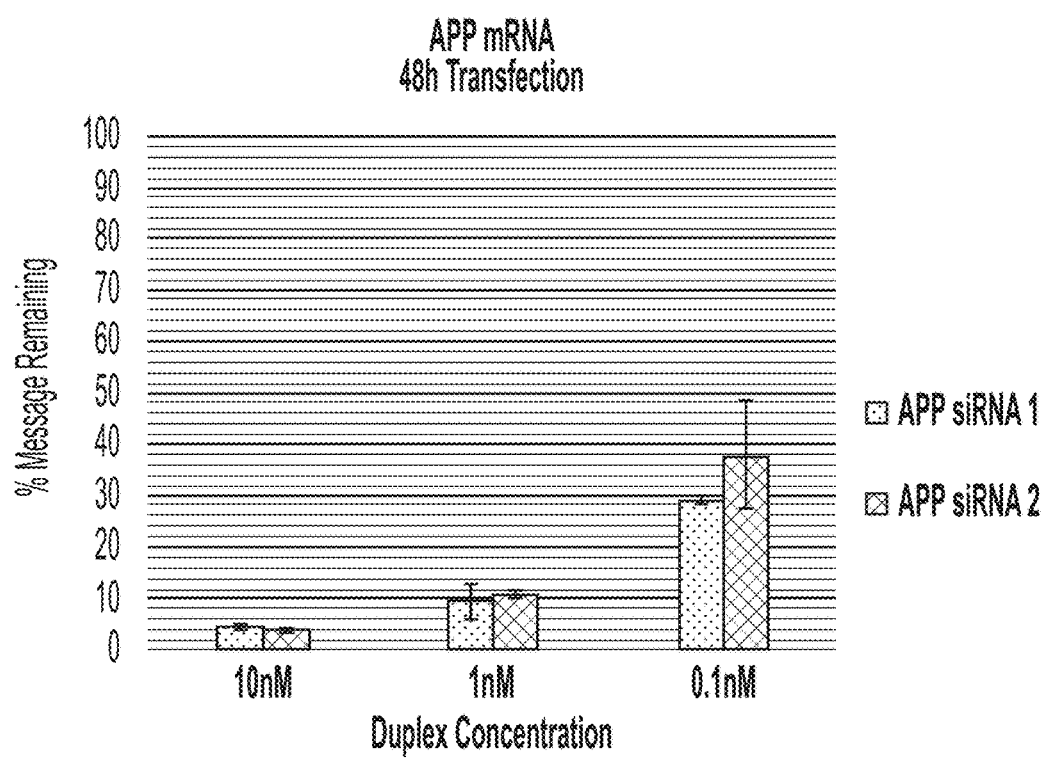
FIG. 4B is a graph showing the applied concentration of APP duplex siRNA vs the percent remaining mRNA in BE(2)C cells 48 hours after transfection.
Figure 4C:
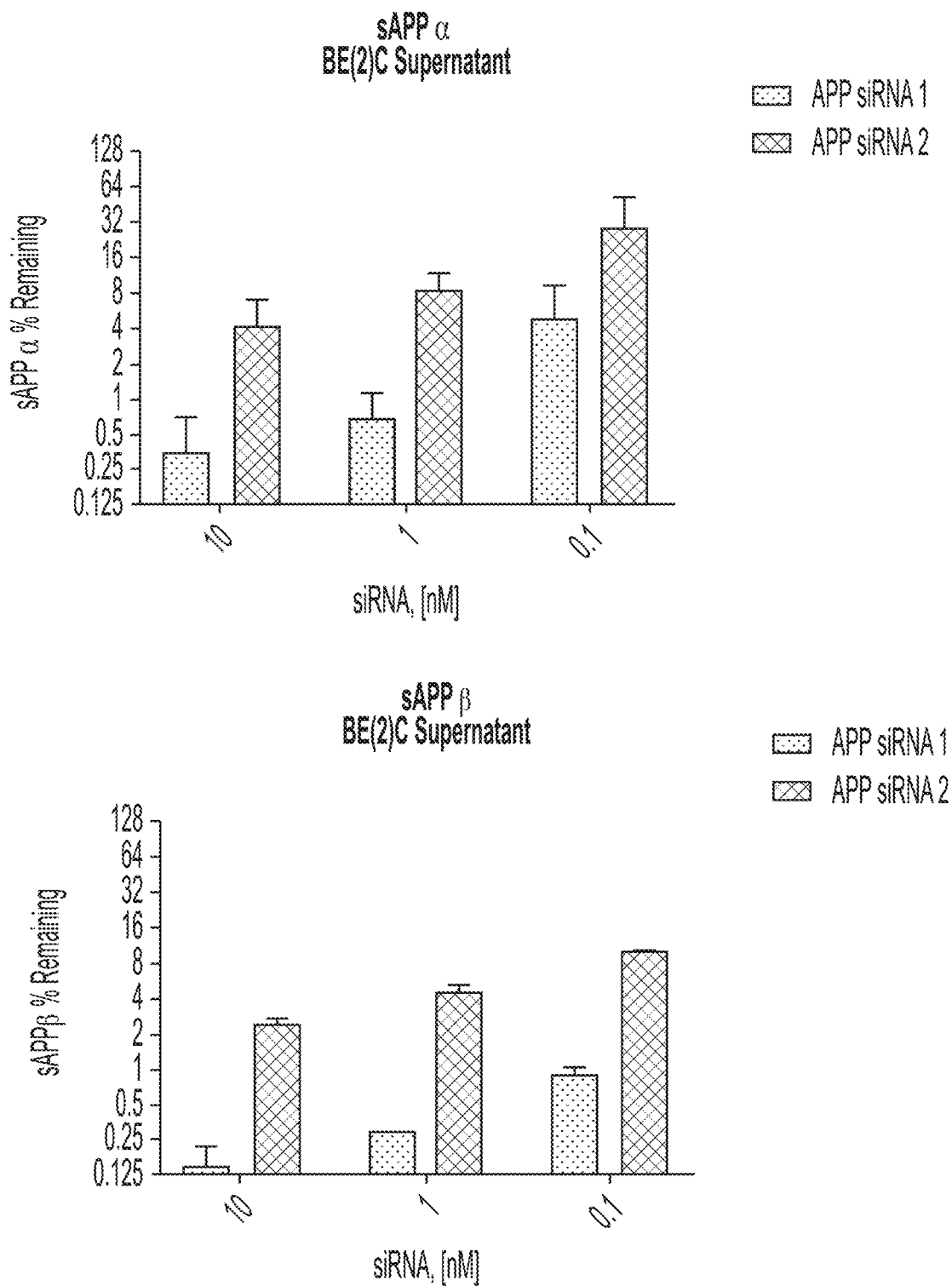
FIG. 4C is two graphs of soluble APP alpha (top) and beta (bottom) species in BE(2)C cells supernatant 48 hours after transfection.

APP siRNA transfected at 10 nM, 1 nM, and 0.1 nM into Be(2)C neuronal cells was evaluated for knockdown of APP mRNA, as well as soluble AAP α/β levels, at both 24 and 48 hours after transfection (see e.g., FIG. 4A, FIG. 4B, and FIG. 4C). A concentration dependent knockdown of APP mRNA was observed for both example siRNAs of interest (e.g., siRNA 1 and siRNA 2 shown in FIGS. 4A-4C). Further, a reduction of cellular APP corresponded to an up to 99% knockdown of soluble AAP α/β in Be(2)C neuronal cell within 48 hours.

Example 4: Intrathecal (IT) Dosing Delivered APP siRNA Throughout the Spinal Cord and Brain of Non-Human Primates Non-Human Primate Studies
Dose Formulation and Preparation
Test Oligonucleotides and Vehicle Information
Test Oligonucleotides: AD-454972
  AD-454973
  AD-454842
  AD-454843
  AD-454844

The current state of scientific knowledge and the applicable guidelines cited previously in this protocol do not provide acceptable alternatives, in vitro or otherwise, to the use of live animals to accomplish the purpose of this study. The development of knowledge necessary for the improvement of the health and well-being of humans as well as other animals requires in vivo experimentation with a wide variety of animal species. Whole animals are essential in research and testing because they best reflect the dynamic interactions between the various cells, tissues, and organs comprising the human body. The beagle is the usual non-rodent model used for evaluating the toxicity of various test articles and for which there is a large historical database. However, the monkey is also an animal model used to evaluate toxicity. The monkey was selected specifically for use in this study because it is the pharmacologically relevant species. The siRNA in the test oligonucleotides is directed against the amyloid precursor protein (APP) mRNA target sequence in monkeys and humans.

| | | | | | | | |
|---|---|---|---|---|---|---|---|
| | | | STUDY DESIGN | | | | |
| Group | Treatment | Dose Level (mg/animal fixed dose) | Dose volume (mL) | Dose Concentration (mg/mL) | Number of Animals (total) | Necropsy (Day 29) | Necropsy (Day 85) |
| 1 | AD-454972 | 72 | 2.4 | 30 | 5 | 3 | 2 |
| 2 | AD-454973 | 72 | 2.4 | 30 | 5 | 3 | 2 |
| 3 | AD-454842 | 72 | 2.4 | 30 | 5 | 3 | 2 |
| 4 | AD-454843 | 72 | 2.4 | 30 | 5 | 3 | 2 |
| 5 | AD-454844 | 72 | 2.4 | 30 | 5 | 3 | 2 |
| 6* | No Treatment | 0 | 0 | 0 | 2 | 2 | 0 |

*Used for tissues collection to provide normal tissue, CSF, and plasma levels of APP in cynomolgus primates. Animals from Groups 1 to 5 with unsuccessful intrathecal cannulation may have been exchanged for those assigned Group 6 animals if no oligonucleotide was given. Animals were necropsied at or before Day 29.

The sequence and structure of the oligonucleotides used in the aforementioned non-human primate studies are described in greater detail in Table 9, below.

TABLE 9

| Agent | Strand (Target) | Modified Sequence | SEQ ID NO: | Unmodified Sequence | SEQ ID NO: |
|---|---|---|---|---|---|
| AD-454972 | Sense (APP) | usasuga(Ahd)GfuUfCfAfucaucaaasasa | 1863 | UAUGAAGUUCAUCAUCAAAAA | 1864 |
| | Antis (APP) | VPusUfsuuug(Agn)ugaugaAfcUfucauasusc | 1865 | UUUUUGAUGAUGAACUUCAUAUC | 1866 |

TABLE 9-continued

| Agent | Strand (Target) | Modified Sequence | SEQ ID NO: | Unmodified Sequence | SEQ ID NO: |
|---|---|---|---|---|---|
| AD-454973 | Sense (APP) | gsgscua(Chd)GfaAfAfAfuccaaccusasa | 1867 | GGCUACGAAAAUCCAACCUAA | 1868 |
| | Antis (APP) | VPusUfsaggu(Tgn)ggauuuUfcGfuagccsgsu | 1869 | UUAGGUTGGAUUUUCGUAGCCGU | 1870 |
| AD-454842 | Sense (APP) | ususugu(Ghd)UfaCfUfGfuaaagaaususa | 1871 | UUUGUGUACUGUAAAGAAUUA | 1872 |
| | Antis (APP) | VPusAfsauuc(Tgn)uuacagUfaCfacaaaasasc | 1873 | UAAUUCUUUACAGUACACAAAAC | 1874 |
| AD-454843 | Sense (APP) | usasgug(Chd)AfuGfAfAfuagauucuscsa | 1875 | UAGUGCAUGAAUAGAUUCUCA | 1876 |
| | Antis (APP) | VPusGfsagaa(Tgn)cuauucAfuGfcacuasgsu | 1877 | UGAGAATCUAUUCAUGCACUAGU | 1878 |
| AD-454844 | Sense (APP) | asasaau(Chd)CfaAfCfCfuacaaguuscsa | 1879 | AAAAUCCAACCUACAAGUUCA | 1880 |
| | Antis (APP) | VPusGfsaacu(Tgn)guagguUfgGfauuuuscsg | 1881 | UGAACUTGUAGGUUGGAUUUUCG | 1882 |

Table 9 key: U = uridine-3'-phosphate, u = 2'-O-methyluridine-3'-phosphate, us = 2'-O-methyluridine-3'-phosphorothioate, a = 2'-O-methyladenosine-3'-phosphorothioate, A = adenosine-3'-phosphate, as = 2'-O-methyladenosine-3'-phosphorothioate, (Ahd) = 2'-O-hexadecyl-adenosine-3'-phosphate, Gf = 2'-fluoroguanosine-3'-phosphate, Uf = fluorouridine-3'-phosphate, Cf = 2'-fluorocytidine-3'-phosphate, Af = 2'-fluoroadenosine-3'-phosphate, cs = 2'-O-methylcytidine-3'-phosphate, VP = Vinylphosphate 5', (Agn) = Adenosine-glycol nucleic acid (GNA), gs = 2'-O-methylguanosine-3'-phosphorothioate, (Chd) = 2'-O-hexadecyl-cytidine-3'-phosphate, (Tgn) = Thymidine-glycol nucleic acid (GNA) S-Isomer, (Ghd) = 2'-O-hexadecyl-guanosine-3'-phosphate, and cs = 2'-O-methylcytidine-3'-phosphorothioate.

Figure 5A:
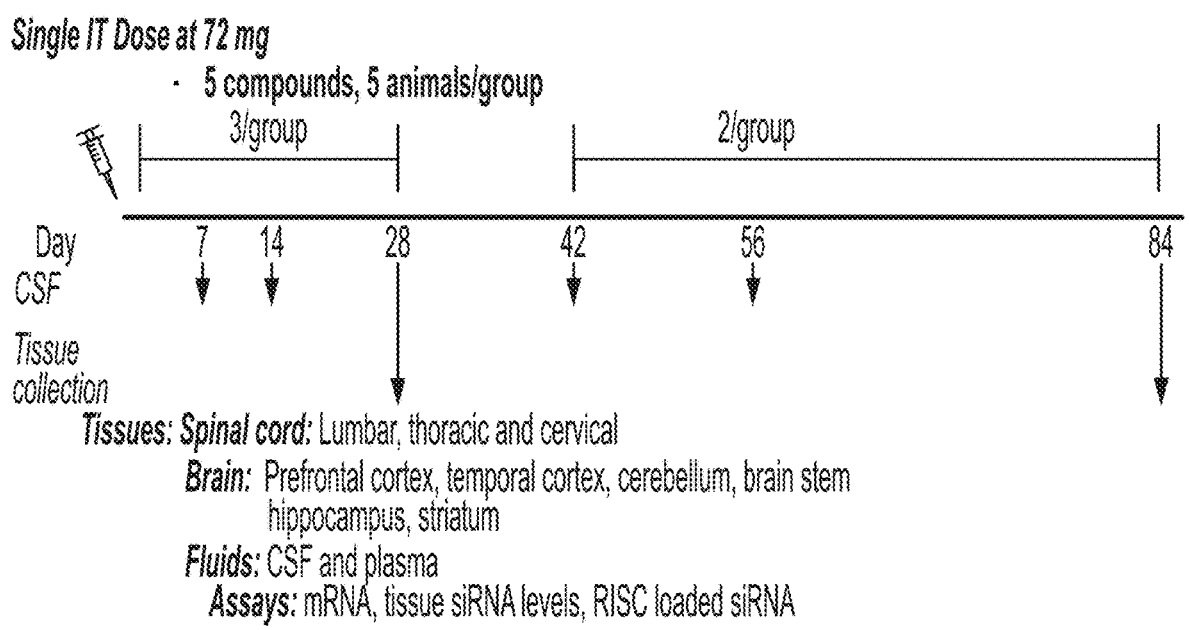
FIG. 5A is a scheme demonstrating the APP siRNA non-human primate (NHP) screening study design. 5 compounds were assessed, and 5 animals were used for each experiment. A single intrathecal (IT) injection of 72 mg of the compound of interest was given at the onset.
Figure 5B:
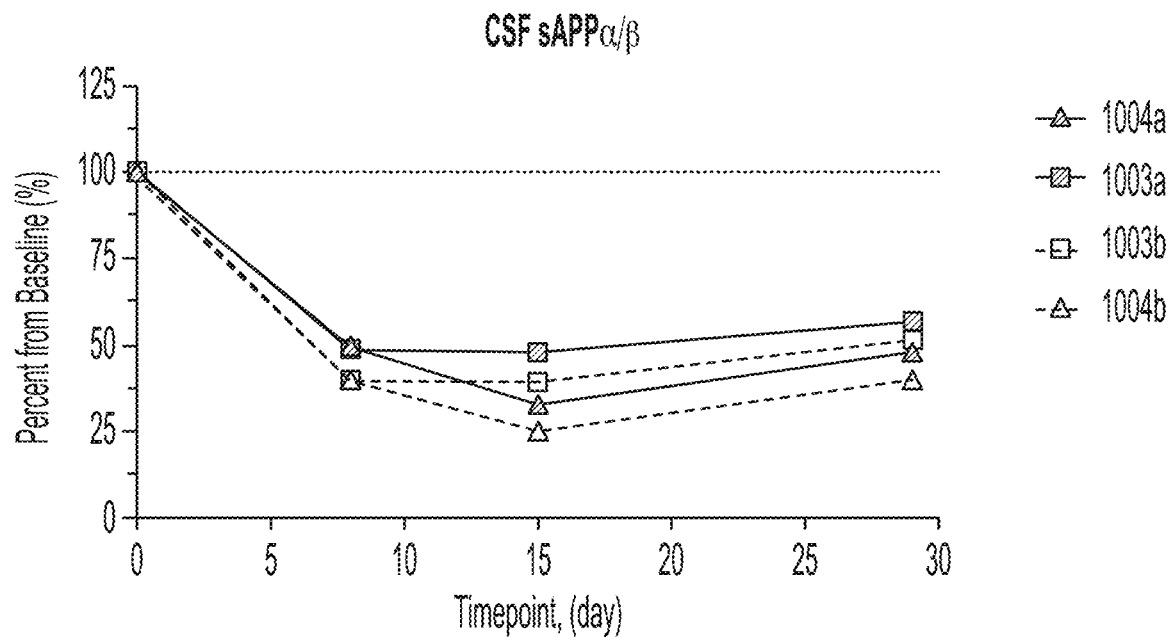
FIG. 5B is two graphs of soluble APP alpha (top) and beta (bottom) species in BE(2)C (bottom), post IT administration in cyno monkeys of 72 mg of AD-454972 targeting APP.
Figure 5B:
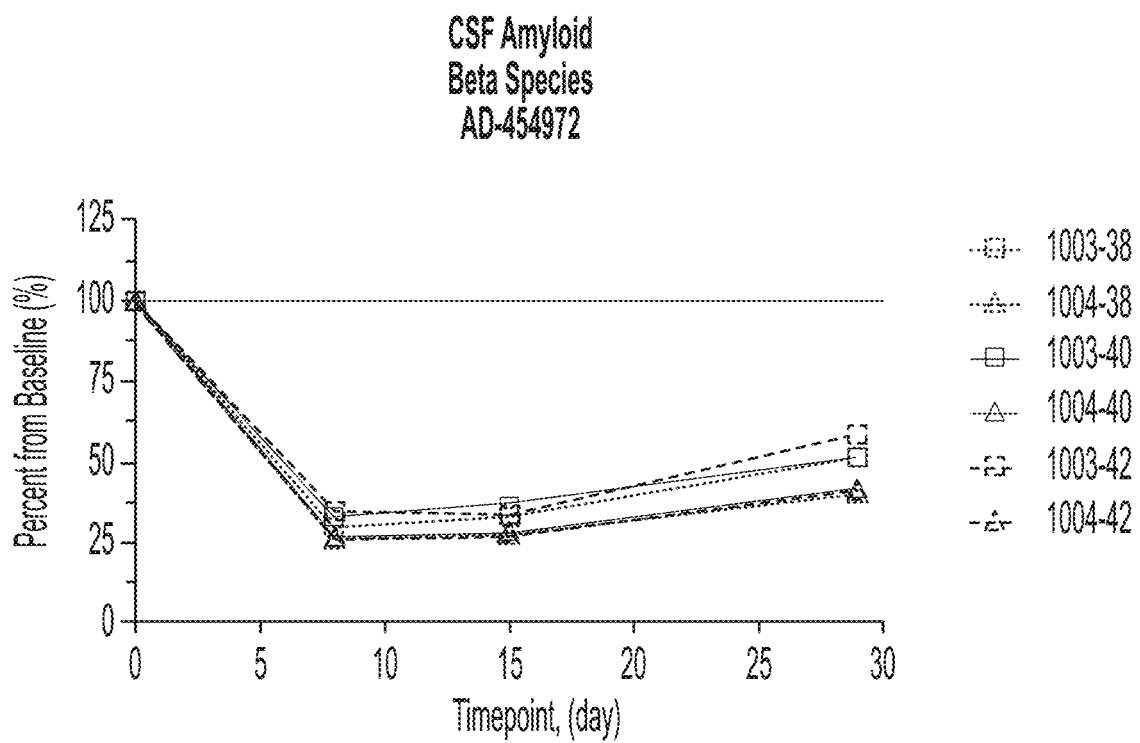
Figures 5C, 5D:
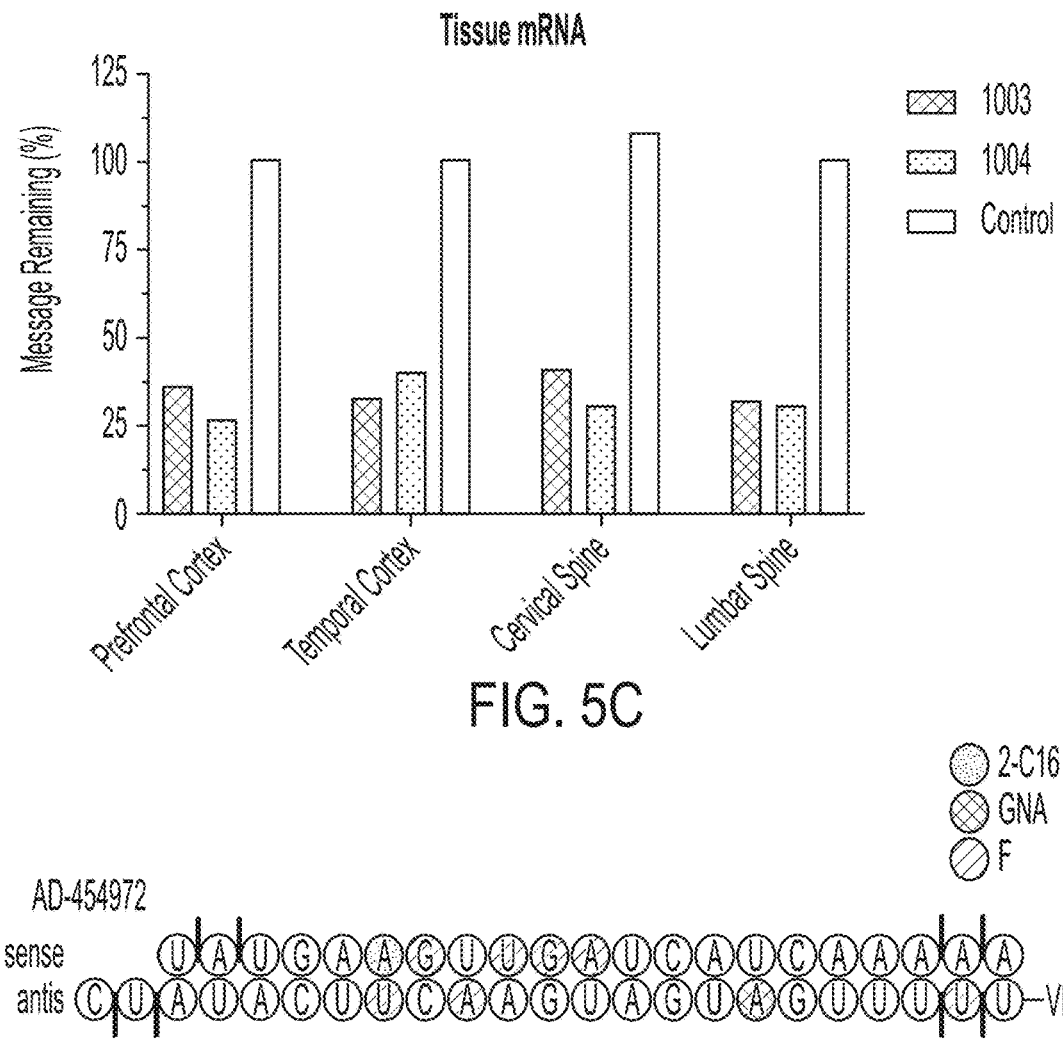
FIG. 5C is a graph showing the results of tissue mRNA knockdown at day 29 post IT administration in cyno monkeys of 72 mg of AD-454972 targeting APP.
FIG. 5D is a scheme demonstrating the structure of the AD-454972 (sense strand SEQ ID NO: 1864; antisense strand SEQ ID NO:1866) compound targeting APP (top) and a table showing the levels of AD-454972 compound delivery in tissue at day 29 post IT administration in cyno monkeys of 72 mg of AD-454972 targeting APP (bottom).
Figure 6:
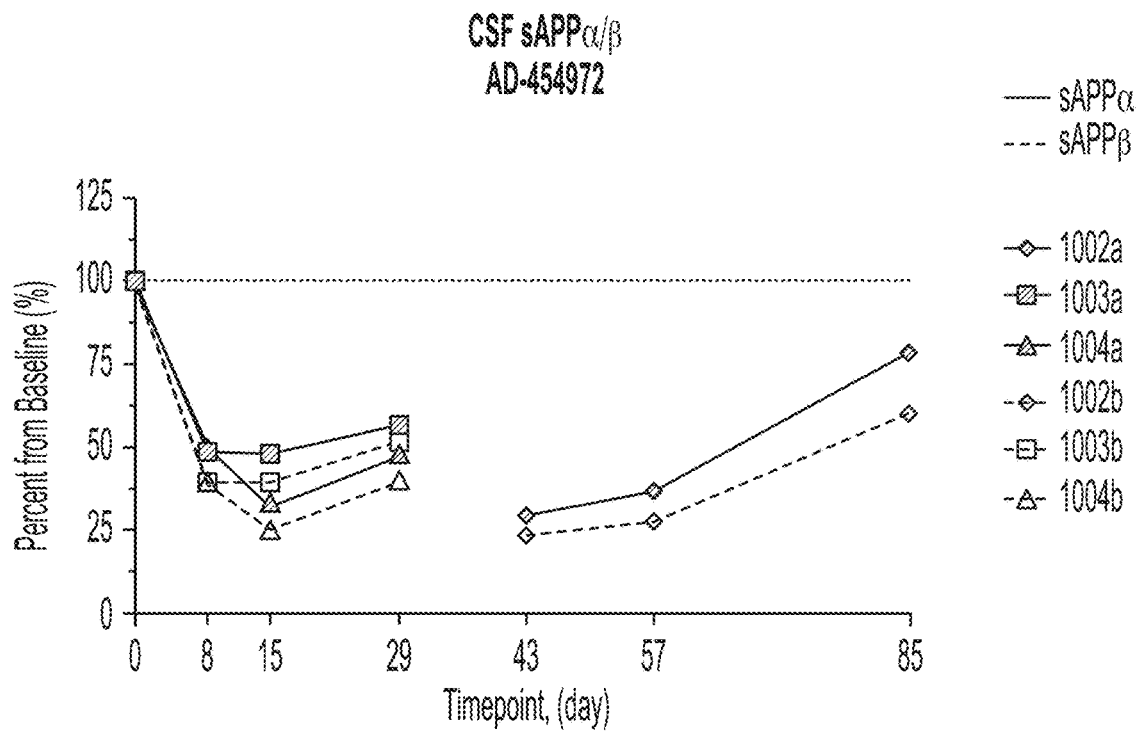
FIG. 6 is two graphs showing the results of CSF soluble APP alpha and beta (top) and CSF amyloid beta species (bottom) collected 2-3 months post IT administration in cyno monkeys of 72 mg of AD-454972 targeting APP.
Figure 6:
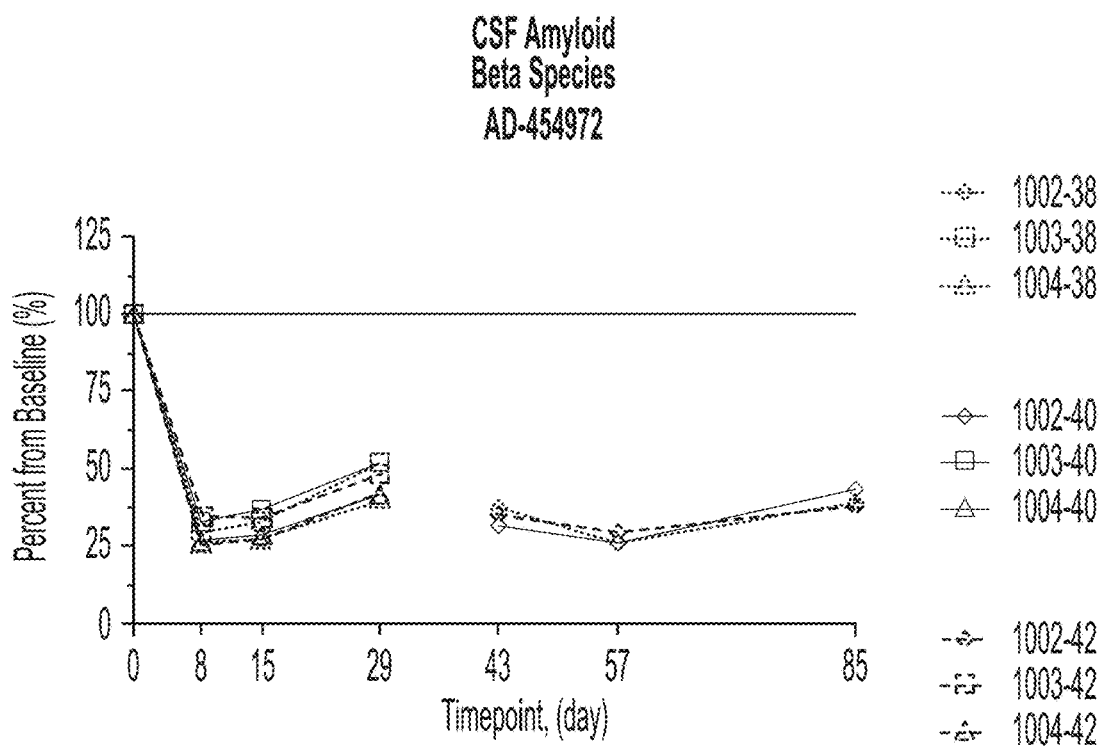

The following are non-limiting examples of knockdown of CSF biomarker and tissue mRNA via intrathecal (IT) injection of 72 mg drug to the CNS tissues of cynomolgus monkeys. A single IT injection, via percutaneous needle stick, of 72 mg of an APP siRNA of interest was administered in cynomolgus monkeys between L2/L3 or L4/L5 in the lumbar cistern (see Methods and Materials below). As shown in FIG. 5A, 5 compounds were assessed, and 5 animals were used for each experiment. Tissues collected were spinal cord (lumbar, thoracic, and cervical) and brain (prefrontal cortex, temporal cortex, cerebellum, brain stem, hippocampus, and striatum). Additionally, collected fluids included both cerebrospinal fluid (CSF) and plasma. Drug levels and mRNA knockdown were assessed at day 29 post dose. As shown in FIG. 5B, APP cc/13, as well as amyloid beta 38, 40, and 42, served as circulating target engagement biomarkers in the CSF and were assessed at days 8, 15, and 29 post-dose. Knockdown in the tissue corresponded to silencing of target engagement biomarkers in the CSF as early as 7 days post dose. As shown in FIG. 5C, IT dosing resulted in sufficient siRNA delivery throughout the spine and brain to result in APP mRNA knockdown at the tissue level. Tested drug levels were assessed by mass spectrometry and are shown in FIG. 5D. In summary, FIGS. 5A-5D show the correlation between CSF biomarker levels, mRNA knockdown, and CNS drug delivery of the APP siRNA AD-454972. Thus, it was notably discovered that CSF biomarker levels and tissue mRNA knockdown exhibited a rapid, robust, and sustained decrease in response to siRNA conjugate drug levels in the CNS. FIG. 6 demonstrates that there is a sustained pharmacodynamic effect observed in the CSF for target engagement biomarkers 2-3 months post dose AD-454972.

Figures 7A, 7B:
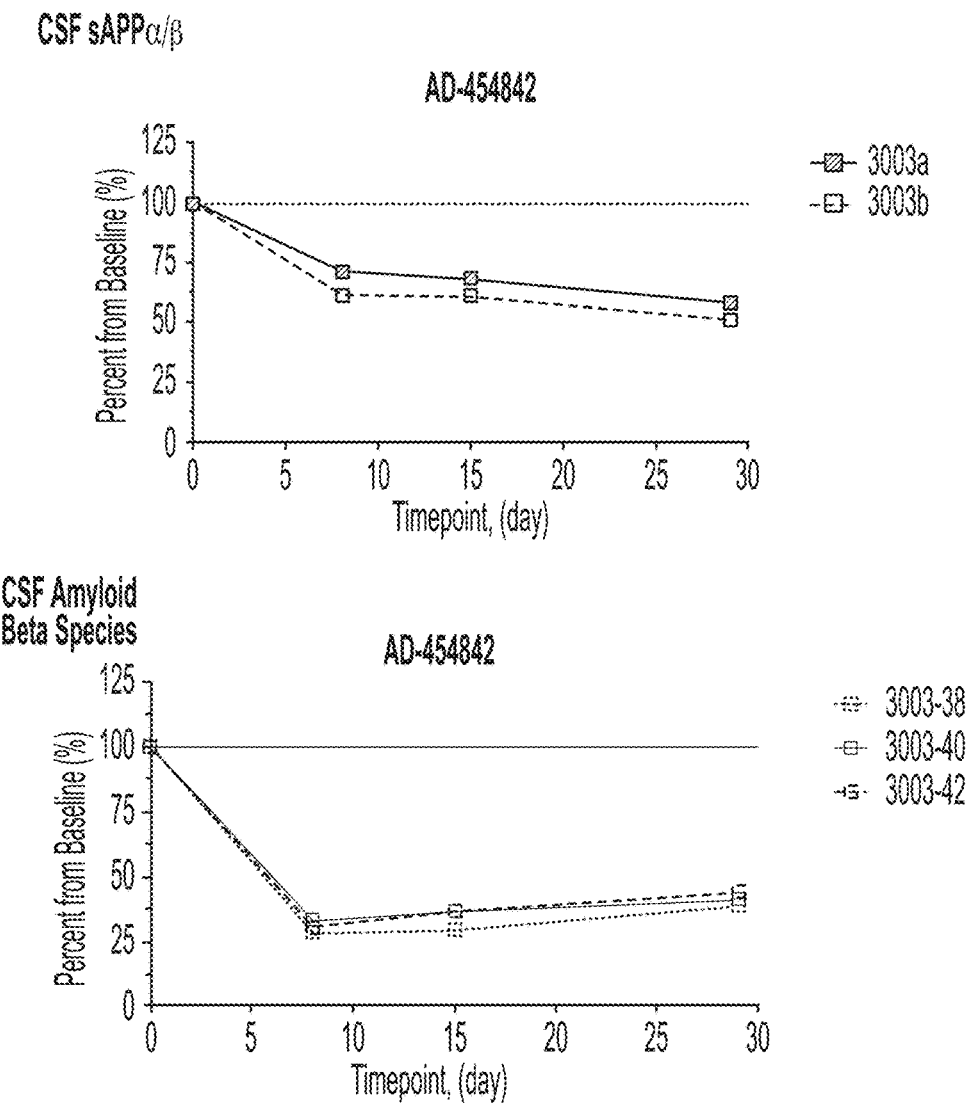
FIG. 7A is two graphs showing the results of CSF collected at days 8, 15, and 29 and analyzed for soluble APP alpha and beta(top) and amyloid beta 38,40, and 42 (bottom), post IT administration in cyno monkeys of 72 mg of AD-454842 targeting APP.
FIG. 7B is a table showing the levels of AD-454842 compound delivery in tissue at day 29 post IT administration in cyno monkeys of 72 mg of AD-454842 targeting APP.

FIG. 7A shows the results of AD-454842 on sAPP α/β in the CSF, while FIG. 7B shows tested drug levels of AD-454842 in tissue assessed by mass spectrometry. In summary, FIGS. 7A-7B show that CSF biomarker levels correlate with drug levels in the CNS for AD-454842, and result in a significant lowering of sAPP in animals with higher tissue drug levels.

Figure 8A:
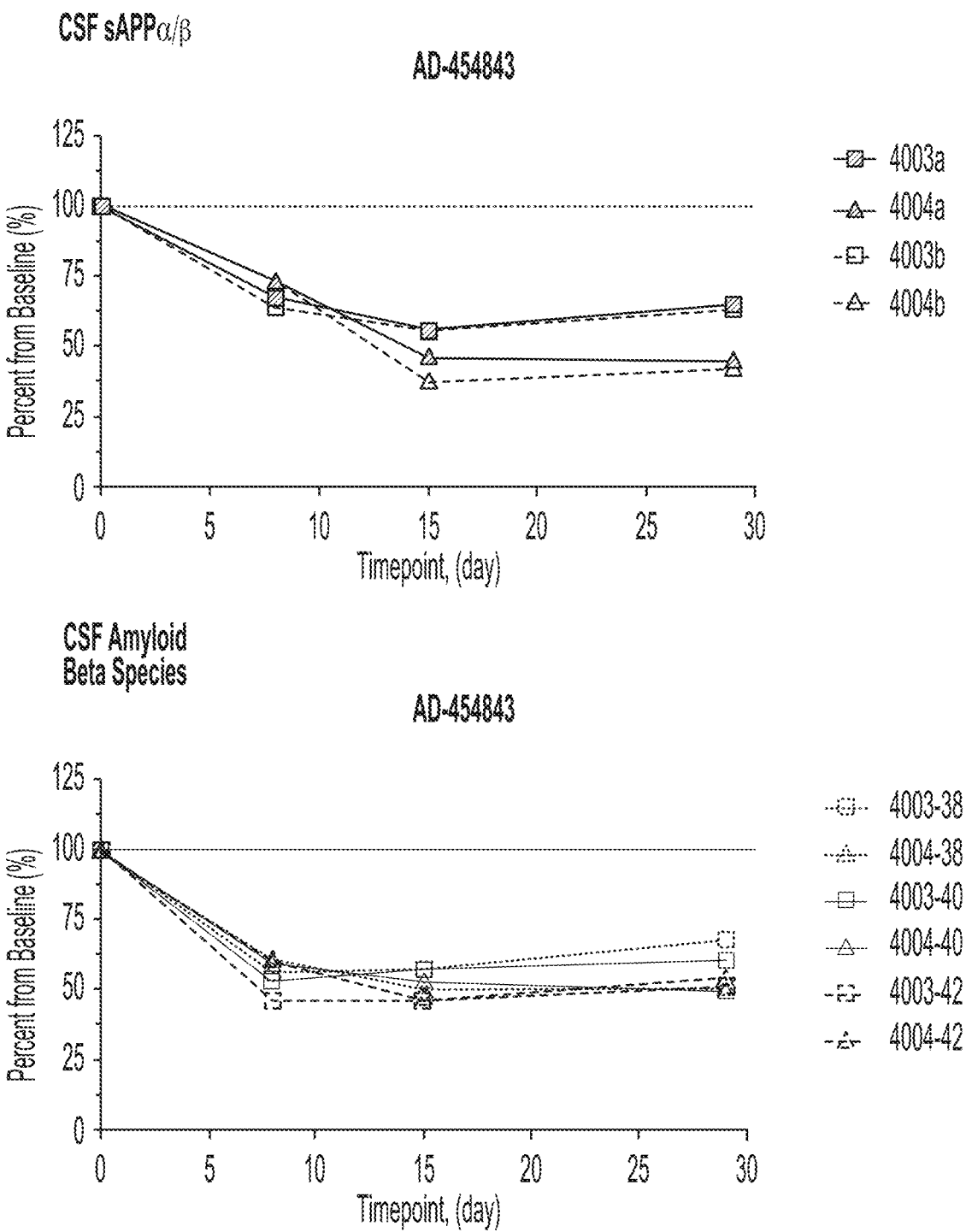
FIG. 8A is two graphs showing the results of CSF collected at days 8, 15, and 29 and analyzed for soluble APP alpha and beta (top) and amyloid beta 38,40, and 42 (bottom), post IT administration in cyno monkeys of 72 mg of AD-454843 targeting APP.
Figures 8B, 8C:
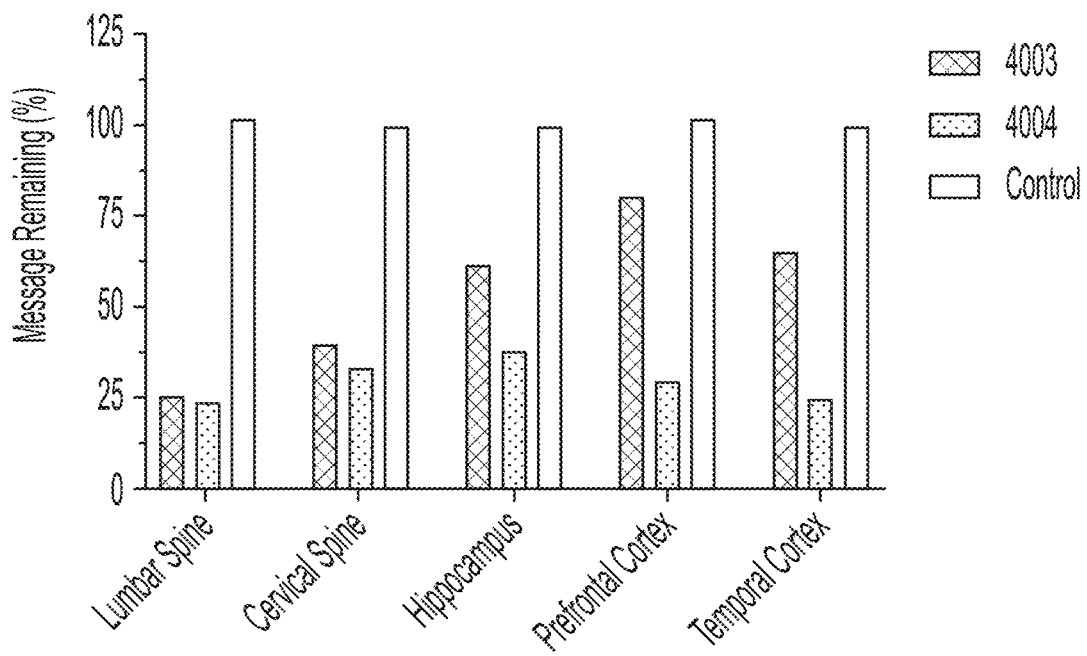
FIG. 8B is a graph showing the results of tissue mRNA knockdown at day 29 post IT administration in cyno monkeys of 72 mg of AD-454843 targeting APP.
FIG. 8C is a table showing the levels of AD-454843 compound delivery in tissue at day 29 post IT administration in cyno monkeys of 72 mg of AD-454843 targeting APP.

FIG. 8A shows the results of AD-454843 on sAPP α/β and amyloid beta species, respectively, in CSF. As shown in FIG. 8B, IT dosing resulted in sufficient siRNA delivery throughout the spine, hippocampus, and cortex regions to result in APP mRNA knockdown at the tissue level. Tested drug levels were assessed by mass spectrometry and are shown in FIG. 8C. Accordingly, FIGS. 8A-8C show a clear correlation between CSF biomarker levels, mRNA knockdown, and CNS drug delivery of AD-454843.

Figure 9A:
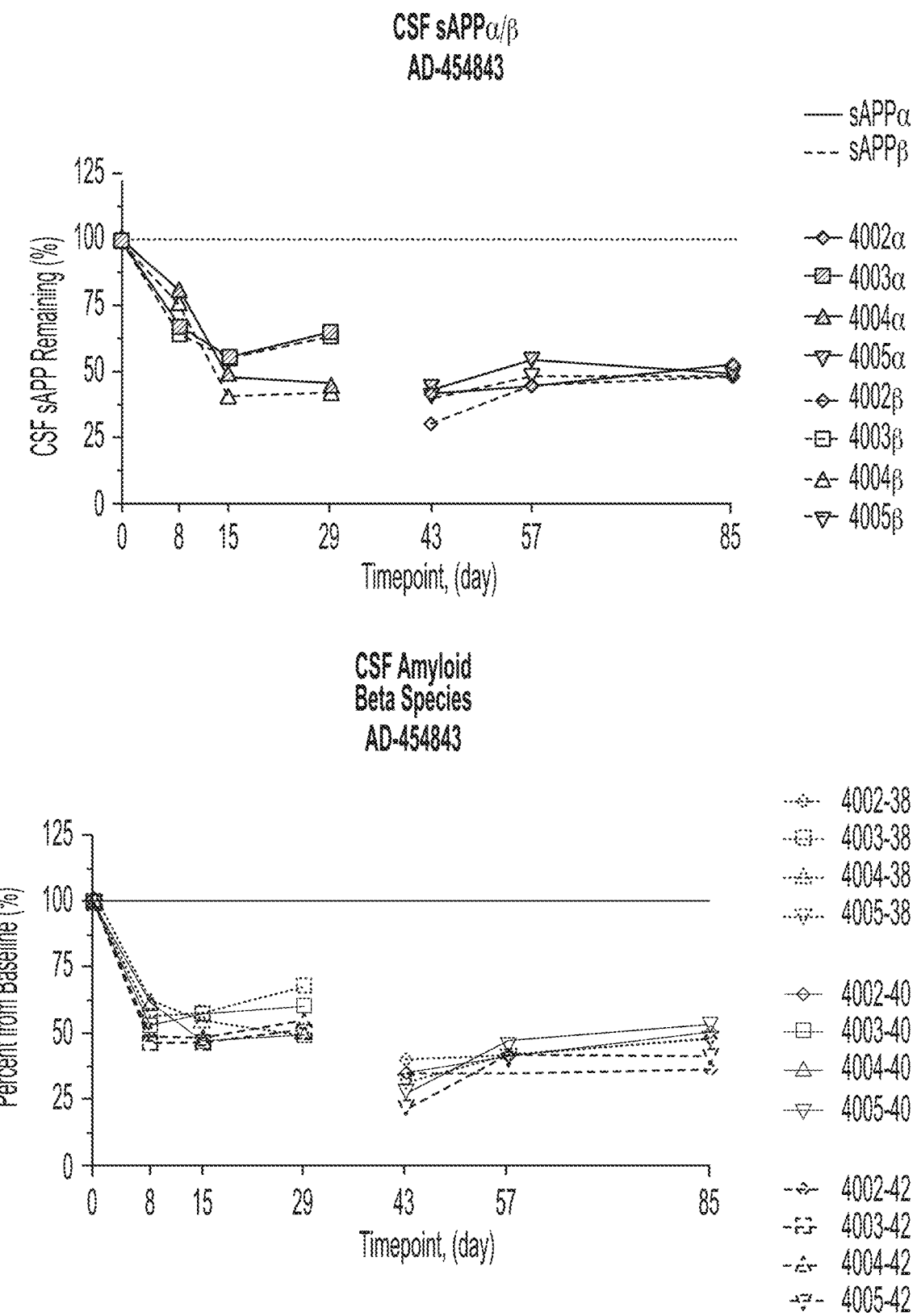
FIG. 9A is two graphs showing the results of CSF soluble APP alpha and beta (top) and CSF amyloid beta species (bottom) collected 2-3 months post IT administration in cyno monkeys of 72 mg of AD-454843 targeting APP.
Figure 9B:
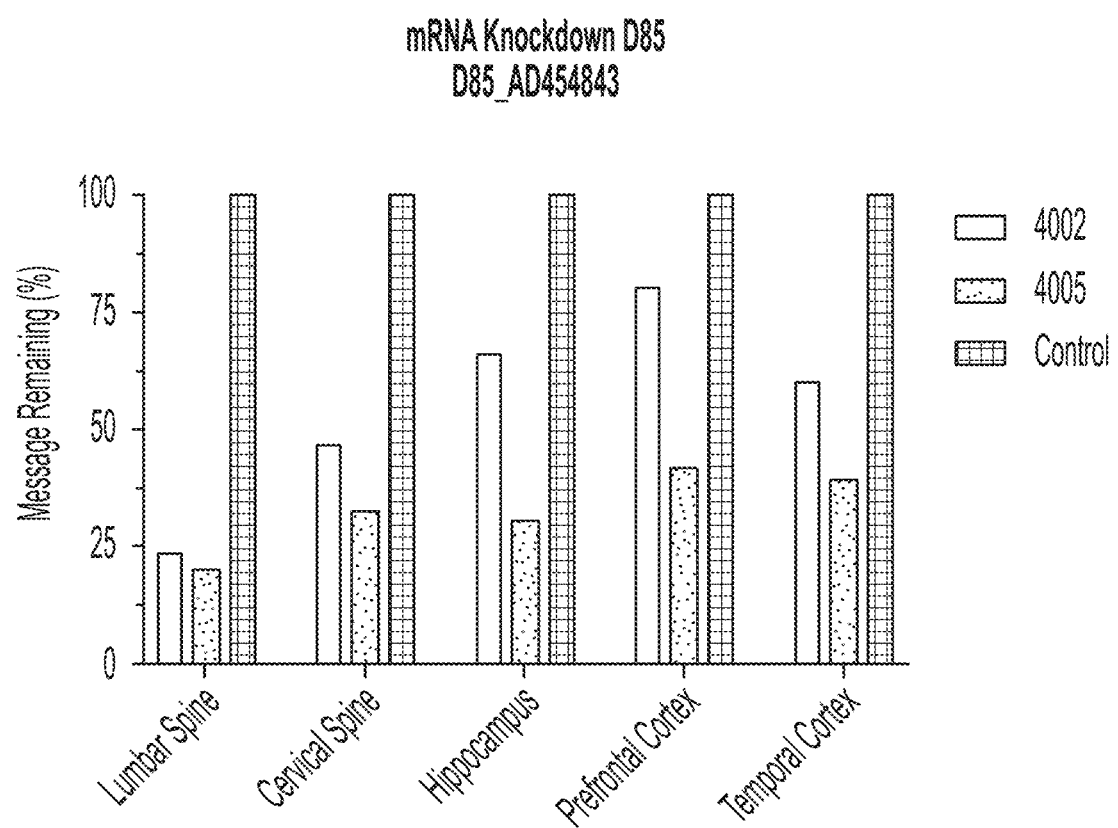
FIG. 9B is a graph showing the results of tissue mRNA knockdown at day 85 post IT administration in cyno monkeys of 72 mg of AD-454843 targeting APP.

FIGS. 9A-9B demonstrate a sustained pharmacodynamic effect observed in the CSF for target engagement biomarkers 2-3 months post-dose for AD-454843. Up to 80% knockdown was observed at the mRNA level in CNS tissue at day 85 post dose in cynomolgus monkeys.

Figure 10A:
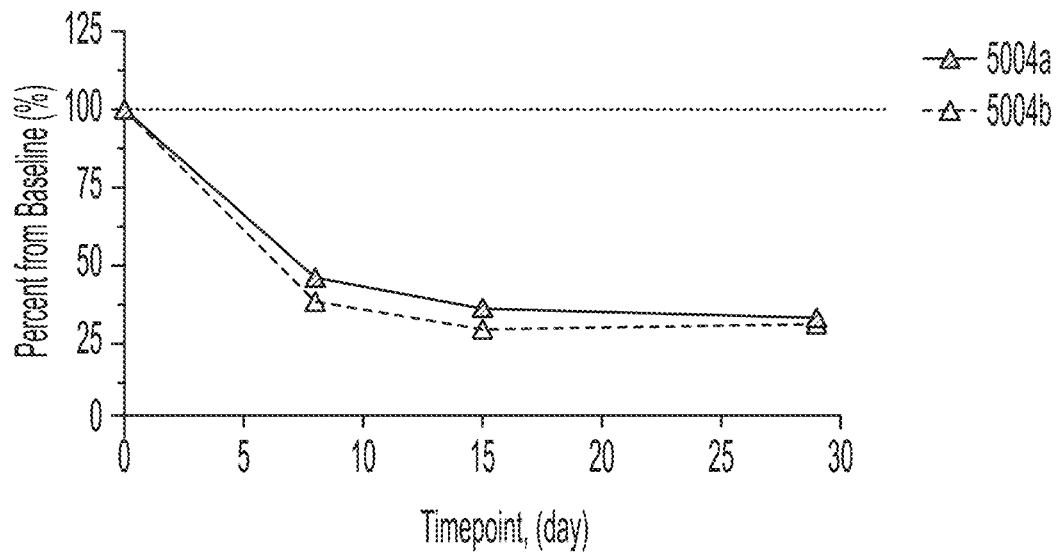
FIG. 10A is two graphs showing the results CSF collected at days 8, 15, and 29 and analyzed for soluble APP alpha and beta (top) and amyloid beta 38,40, and 42 (bottom), post IT administration in cyno monkeys of 72 mg of AD-454844 targeting APP.
Figure 10A:
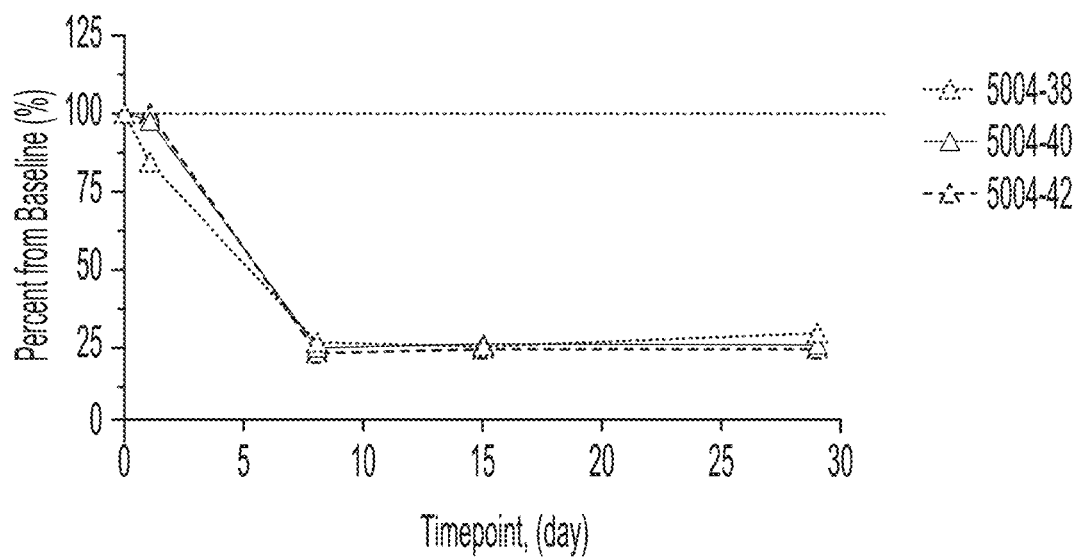
Figure 10B:
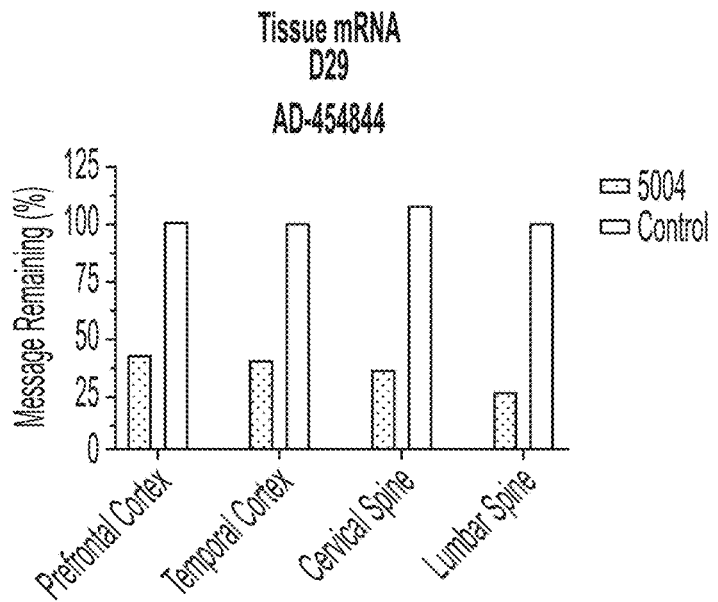
FIG. 10B is a graph showing the results of tissue mRNA knockdown at day 29 post IT administration in cyno monkeys of 72 mg of AD-454844 targeting APP.
Figure 10C:
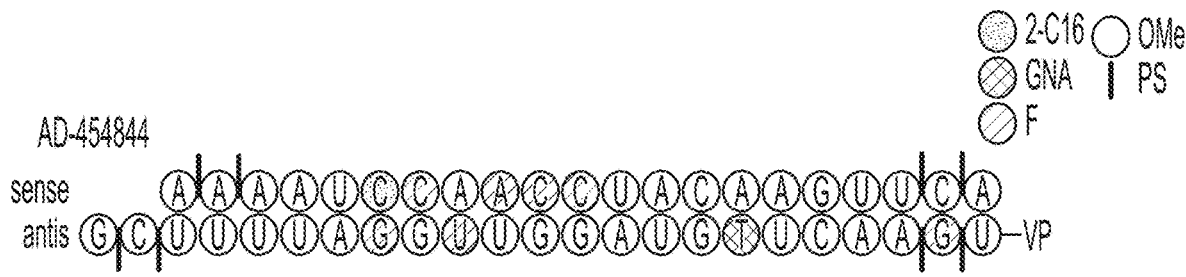
FIG. 10C is a scheme demonstrating the structure of the AD-454844 (sense strand SEQ ID NO: 1880; antisense strand SEQ ID NO:1882) compound targeting APP (top) and a table showing the levels of AD-454844 compound delivery in tissue at day 29 post IT administration in cyno monkeys of 72 mg of AD-454844 targeting APP (bottom).

FIGS. 10A-10C show the correlation between CSF biomarker levels, mRNA knockdown, and CNS drug delivery for AD-454844. Tested drug levels were assessed by mass spectrometry and are shown in FIG. 10C.

Figures 11A, 11B:
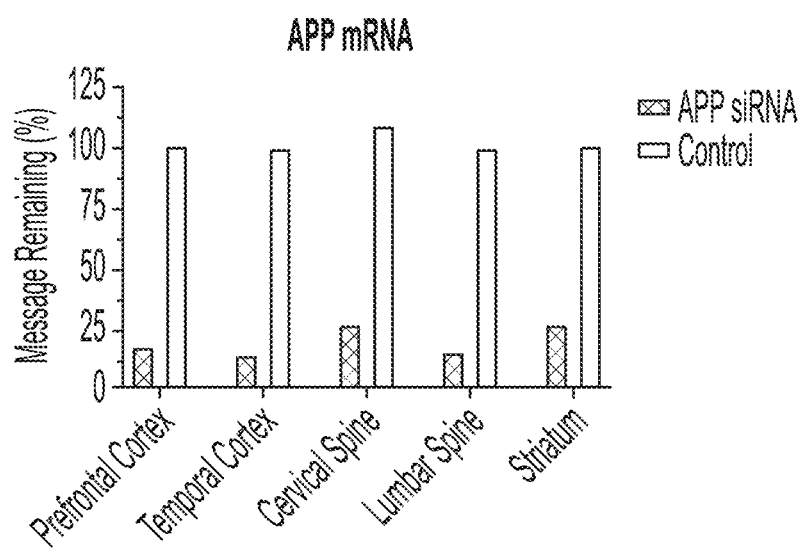
FIG. 11A is a table showing a high level of compound delivery in tissue at day 29 post IT administration in cyno monkeys of 72 mg siRNA targeting APP.
FIG. 11B is a graph showing the results of tissue mRNA knockdown at day 29 post IT administration in cyno monkeys of a high level (FIG. 11A) of compound delivery targeting APP.
Figure 11C:
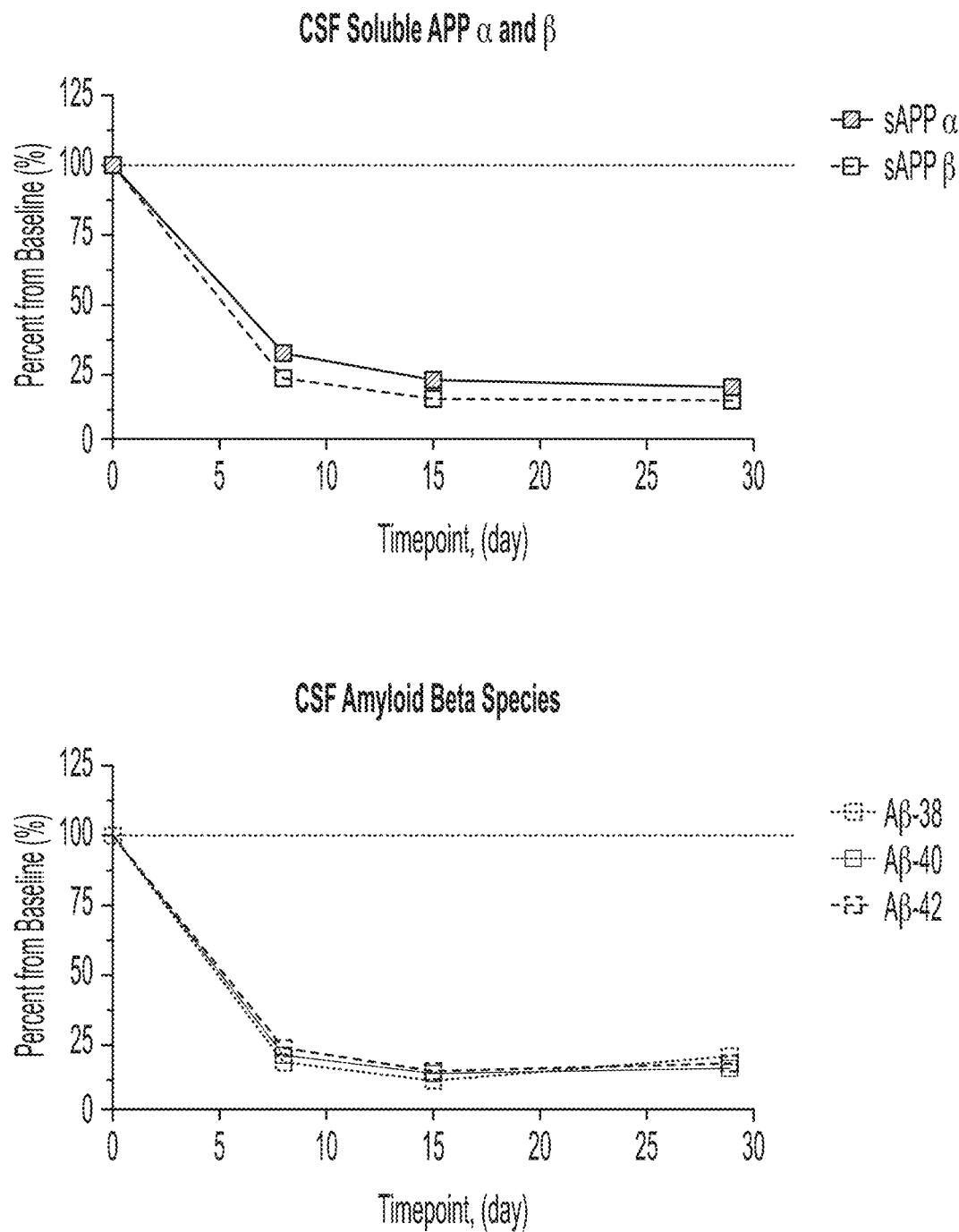
FIG. 11C is two graphs showing the results of CSF collected at days 8, 15, and 29 and analyzed for soluble APP alpha and beta(top) and amyloid beta 38,40, and 42 (bottom), post IT administration in cyno monkeys of 72 mg of of a high level of compound delivery (FIG. 11A) targeting APP.

FIGS. 11A-11C show that optimal delivery of the APP lead siRNA demonstrates robust activity. For example, the results of high levels of the drug on mRNA knockdown and silencing of target engagement biomarkers shows that high μg/g drug levels in tissue correlated with a 75-90% knockdown in CNS tissues such as the cortex and spine. Surprisingly, optimal delivery also showed significant knockdown in the striatum.

Figure 12A:
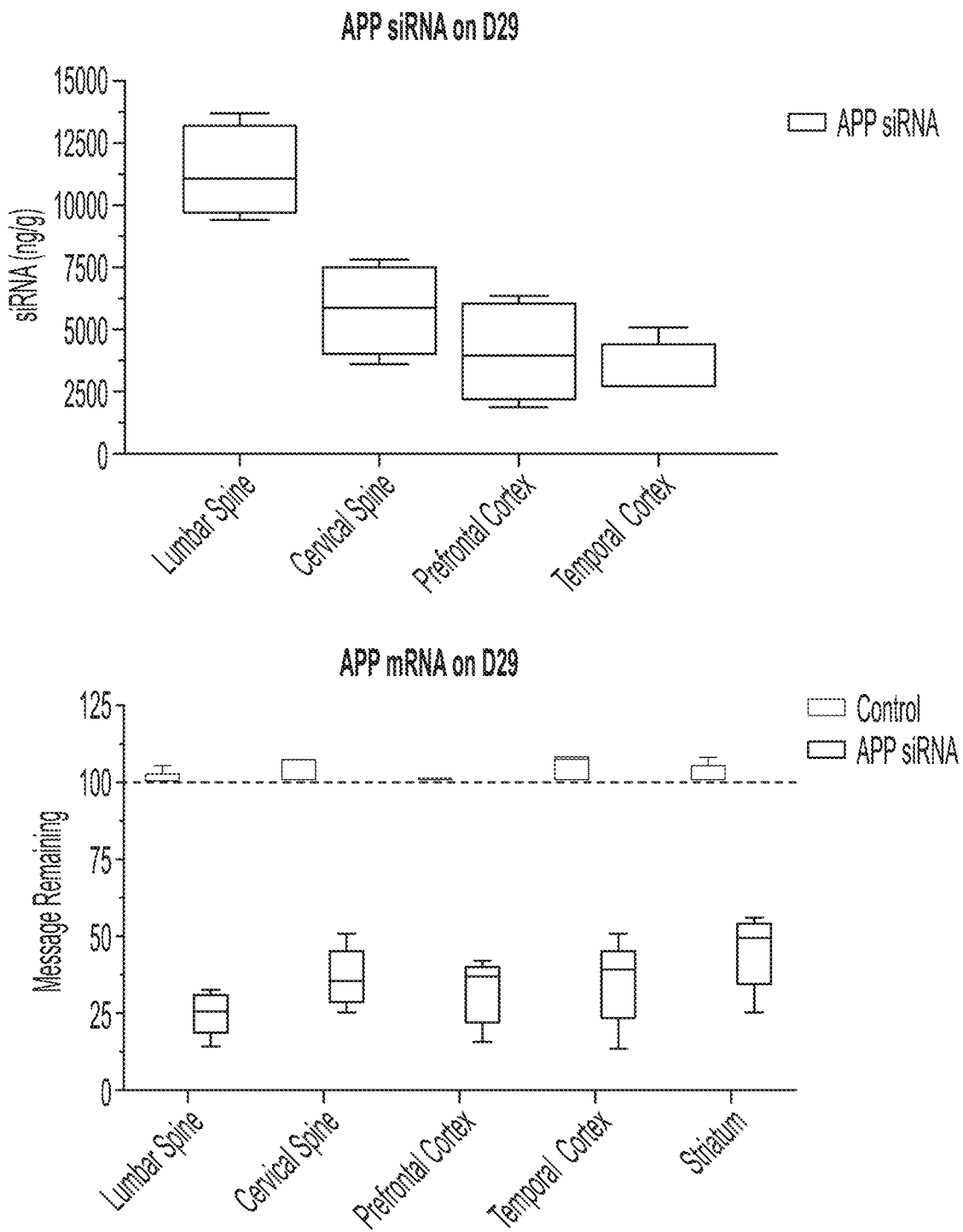
FIG. 12A is two plots showing the average of 5 miRNA duplex studies. Top panel is a box plot of the results of 5 compounds at day at day 29 post IT administration in cyno monkeys of 72mg siRNA. Bottom panel is a box plot of the amount of mRNA remaining in each tissue relative to a control 29 days post IT administration in cyno monkeys.
Figure 12B:
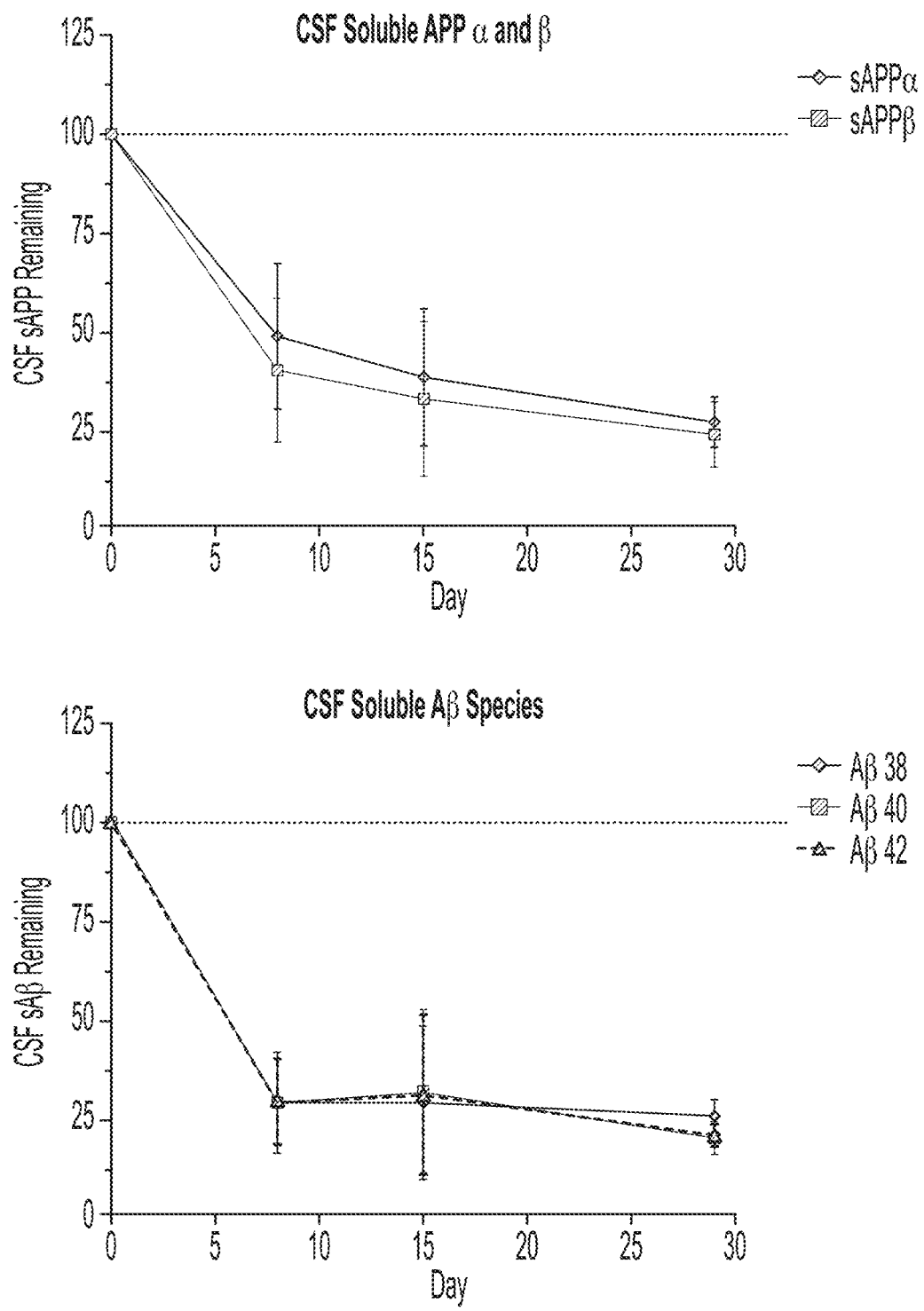
FIG. 12B is two two plots showing repeated miRNA duplex studies in which CSF was collected at days 8, 15, and 29 and analyzed for soluble APP alpha and beta (top) and amyloid beta 38,40, and 42 (bottom), post IT administration in cyno monkeys of 72 mg of siRNA compounds targeting APP.
Figure 13A:
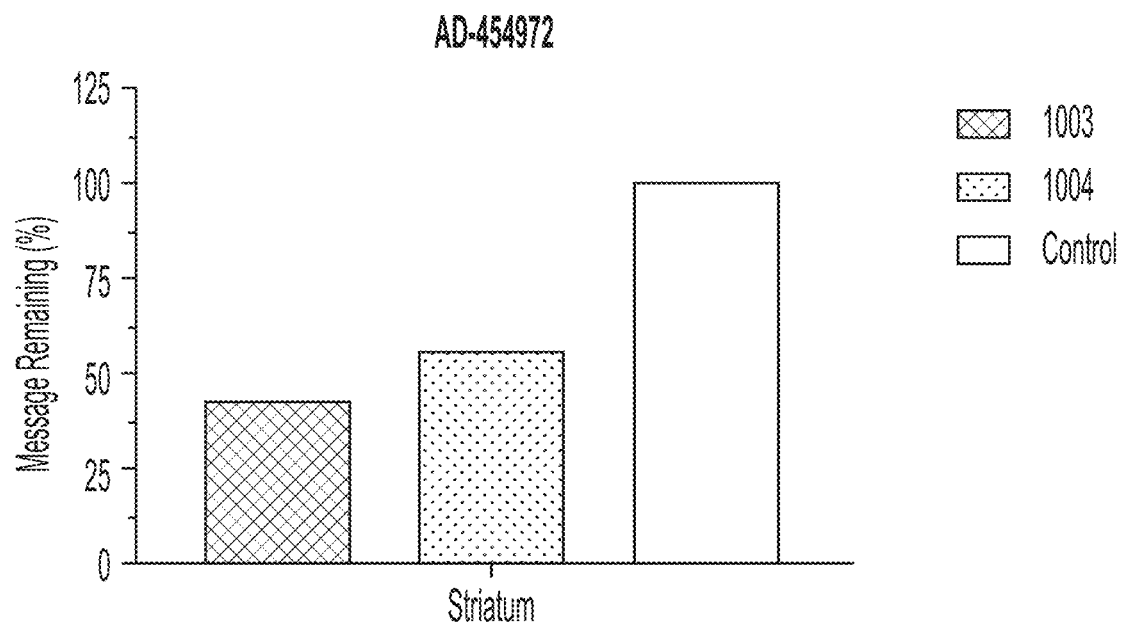
FIG. 13A is a graph demonstrating the percent APP mRNA remaining in striatum tissue 29 days post IT administration in cyno monkeys of AD-454972 targeting APP.
Figure 13B:
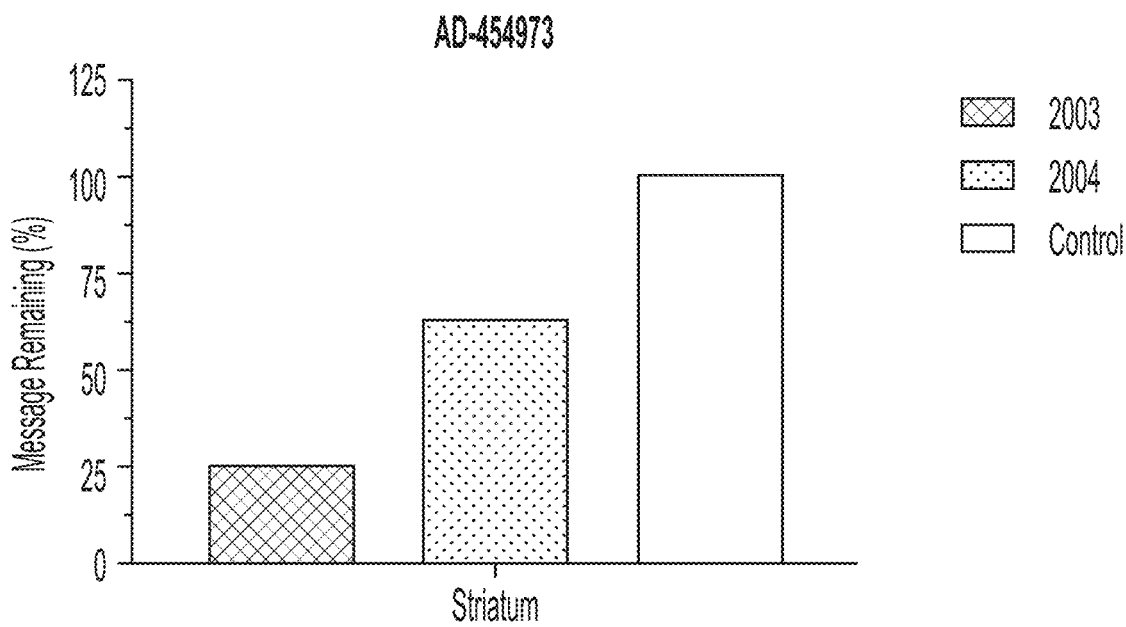
FIG. 13B is a graph demonstrating the percent APP mRNA remaining in striatum tissue 29 days post IT administration in cyno monkeys of AD-454973 targeting APP.
Figure 13C:
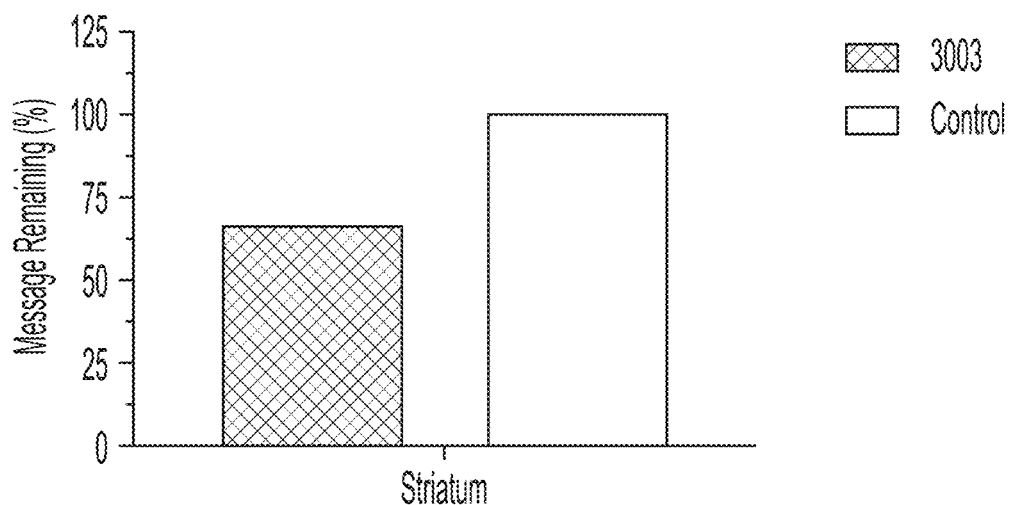
FIG. 13C is a graph demonstrating the percent APP mRNA remaining in striatum tissue 29 days post IT administration in cyno monkeys of AD-454842 targeting APP.
Figure 13D:
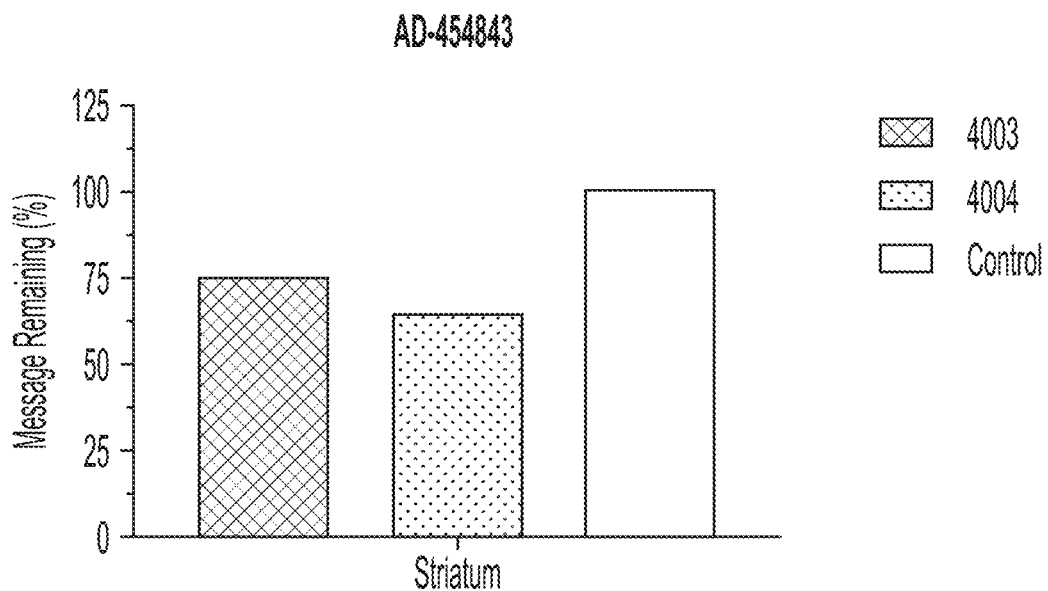
FIG. 13D is a graph demonstrating the percent APP mRNA remaining in striatum tissue 29 days post IT administration in cyno monkeys of AD-454843 targeting APP.
Figure 13E:
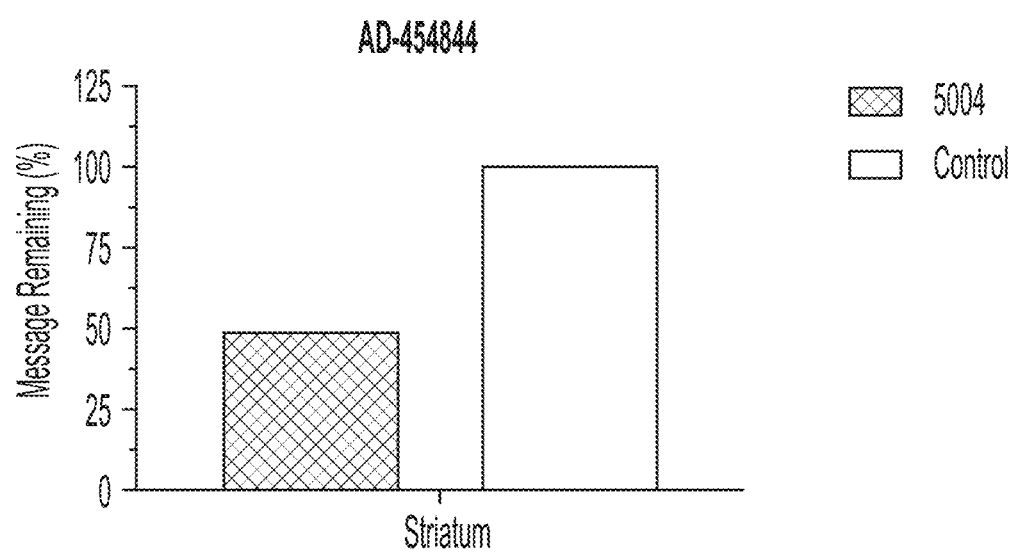
FIG. 13E is a graph demonstrating the percent APP mRNA remaining in striatum tissue 29 days post IT administration in cyno monkeys of AD-454844 targeting APP.

FIG. 12A shows the average of 5 duplexes; collectively, IT dosing resulted in sufficient siRNA delivery such that APP mRNA was knocked down by 60-75% at the tissue level at day 29. Further, as shown in FIG. 12B, soluble APP α/β, as well as amyloid beta 38, 40 and 42, were lowered by 75% in the CSF at day 29.

APP mRNA Knockdown in Non-Human Primate Striatum at Day 29 Post Dose

A single intrathecal (IT) injection, via percutaneous needle stick, of 72 mg of the APP siRNA of interest was administered in cynomolgus monkeys between L2/L3 or L4/L5 in the lumbar cistern. In the instant disclosure, the notable discovery was made that siRNA conjugate compound delivery resulted in APP mRNA knockdown within the striatum. The following siRNAs were observed to knockdown APP mRNA in non-human primate striatum at day 29 post dose: AD-454972, AD-454973, AD-454842, AD-454843, and AD-454844 (as shown in FIGS. 13A-13E).

Materials and Methods
Soluble APP Alpha/Soluble APP Beta

CSF levels of sAPPα and sAPPβ were determined utilizing a sandwich immunoassay MSD® 96-well MULTI-SPOT sAPPα/sAPPβ assay (Catalog no. K15120E; Meso Scale Discovery, Rockville, Md., USA) according to the manufacturer's protocol with some modifications. The standards, blanks, and non-human primate CSF samples (8× dilution) were prepared with the 1% Blocker-A/TBST (provided in the kit). Pre-coated plate (provided in the kit) was blocked with 150 μL/well of 3% Blocker A/TBST solution at room temperature for 1 hour with shaking. After three washes with 1×TBST, 25 μL/well of prepared standard, blanks, and CSF samples were added to the plate in two replicates and incubated for 1 hour at room temperature with shaking. Following subsequent plate washes, 50 μL/well of detection antibody prepared in 1% Blocker A/TBST (50× dilution) was added and incubated at room temperature for 1 hour with shaking. After plate washes, 1× Read Buffer T was added to the plate and incubated for 10 minutes at room temperature (without shaking) before imaging and analyzing in MSD QuickPlex Imager.

Raw data were analyzed using SoftMax Pro, version 7.1 (Molecular Devices). A 5-parameter, logistic curve fitting with $1/Y^2$ weighing function was used to model the individual calibration curves and calculate the concentration of analytes in the samples.

Beta Amyloid Panel (Aβ40, Aβ38, Aβ42)

CSF levels of Beta-amyloid (Aβ40, Aβ38, Aβ42) were determined utilizing a sandwich immunoassay multiplex kit MSD® 96-well MULTI-SPOT AB Peptide Panel 1 V-Plex (Catalog No. K15200E, Meso Scale Discovery, Rockville, Md., USA) according to the manufacturer's protocol with some modifications. The standards, blanks, and non-human primate CSF (8× dilution) were prepared with Diluent 35 (provided in the kit). Detection antibody (supplied at 50×) was prepared at a working concentration of 1× in Diluent 100 (provided in the kit) combined with 30 μL of A1340 Blocker. Pre-coated plate (provided in the kit) was blocked with 150 μL/well with Diluent 35 for 1 hour at room temperature with shaking. After three washes with 1×PBST, 25 μl/well of prepared detection antibody solution was added to the plate. Following with the addition of 25 μL/well of prepared standards, blanks, and samples in two replicates, plate was incubated at room temperature for 2 hours with shaking. Following subsequent plate washes, 150 μL/well of 2× Read buffer T was added and plate was imaged and analyzed in the MSD QuickPlex Imager immediately.

Raw data were analyzed using SoftMax Pro, version 7.1 (Molecular Devices, San Jose, Calif., USA). A 4-parameter, logistic curve fitting with $1/Y^2$ weighing function was used to model the individual calibration curves and calculate the concentration of analytes in the samples.

Mass Spec Method

Drug concentrations in plasma, CSF and CNS tissue samples were quantitated using a qualified LC-MS/MS method. Briefly, tissue samples were homogenized in lysis buffer, then the oligonucleotides were extracted from plasma, CSF or tissue lysate by solid phase extraction and analyzed using ion-pairing reverse phase liquid chromatography coupled with mass spectrometry under negative ionization mode. The concentration of the full-length antisense strand of the dosed duplex was measured. The drug concentrations were reported as the antisense-based duplex concentrations. The calibration range is 10-5000 ng/mL for plasma and CSF samples, and 100-50000 ng/g for CNS tissue samples. Concentrations that were calculated below the LLOQ are reported as <LLOQ. An analog duplex with different molecular weight was used as internal standard.

mRNA Knockdown by qPCR Method

Total RNA was isolated from rat brain and spinal cord tissue samples using the miRNeasy Mini Kit from (Qiagen, Catalog No. 217004) according to the manufacturer's instructions. Following isolation, RNA was reverse transcribed using SuperScript™ IV VILO™ Reverse Transcriptase (Thermo Fisher Scientific). Quantitative PCR analysis was performed using a ViiA7 Real-Time PCR System from Thermo Fisher Scientific of Waltham Mass. 02451 (Catalog No. 4453537) with Taqman Fast Universal PCR Master Mix (Applied Biosystems Catalog No. 4352042), pre-validated amyloid beta precursor protein (APP) (Mf01552291_m1) and peptidylprolyl isomerase B (PPIB) (Mf02802985 ml) Taqman Gene Expression Assays (Thermo Fisher Scientific).

The relative reduction of APP mRNA was calculated using the comparative cycle threshold (Ct) method. During qPCR, the instrument sets a baseline in the exponential phase of the amplification curve and assigns a Ct value based on the intersection point of the baseline with the amplification curve. The APP mRNA reduction was normalized to the experimental untreated control group as a percentage for each respective group using the Ct values according to the following calculations:

$$\Delta Ct_{App} = Ct_{App} - Ct P_{pib}$$

$$\Delta\Delta Ct_{App} = \Delta Ct_{App} - \Delta Ct_{untreated\ control\ group\ mean}$$

Relative mRNA level=$2^{-\Delta\Delta Ct}$

Example 5: Additional RNAi Agent Design, Synthesis, and In Vitro Screening in Cos-7, Be(2)-C, and Neuro-2a Cell Lines This Example describes methods for the design, synthesis, selection, and in vitro screening of additional APP RNAi agents in Cos-7 (Dual-Luciferase psiCHECK2 vector), Be(2)-C, and Neuro-2a cells.

Source of Reagents

Where the source of a reagent is not specifically given herein, such reagent can be obtained from any supplier of reagents for molecular biology at a quality/purity standard for application in molecular biology.

Cell Culture and Transfections:

Cos-7 cells (ATCC) were transfected by adding 5 μl of 1 ng/μl, diluted in Opti-MEM, C9orf72 intron 1 psiCHECK2 vector (Blue Heron Biotechnology), 4.9 μl of Opti-MEM plus 0.1 μl of Lipofectamine 2000 per well (Invitrogen, Carlsbad Calif. cat #11668-019) to 5 µl of siRNA duplexes per well, with 4 replicates of each siRNA duplex, into a 384-well plate, and incubated at room temperature for 15 minutes. Thirty-five µl of Dulbecco's Modified Eagle Medium (ThermoFisher) containing ~5×10$^3$ cells were then added to the siRNA mixture. Cells were incubated for 48 hours followed by Firefly (transfection control) and *Renilla* (fused to target sequence) luciferase measurements. Three dose experiments were performed at 10 nM, 1 nM, and 0.1 nM.

Be(2)-C cells (ATCC) were transfected by adding 4.9 µl of Opti-MEM plus 0.1 µl of RNAiMAX per well (Invitrogen, Carlsbad Calif. cat #13778-150) to 5 µl of siRNA duplexes per well, with 4 replicates of each siRNA duplex, into a 384-well plate, and incubated at room temperature for 15 minutes. Forty µl of 1:1 mixture of Minimum Essential Medium and F12 Medium (ThermoFisher) containing ~5×10$^3$ cells were then added to the siRNA mixture. Cells were incubated for 48 hours prior to RNA purification. Two dose experiments were performed at 10 nM and 0.1 nM.

Neuro-2a cells (ATCC) were transfected by adding 4.9 µl of Opti-MEM plus 0.1 µl of RNAiMAX per well (Invitrogen, Carlsbad Calif. cat #13778-150) to 5 µl of siRNA duplexes per well, with 4 replicates of each siRNA duplex, into a 384-well plate, and incubated at room temperature for 15 minutes. Forty µl of Minimum Essential Medium (ThermoFisher) containing ~5×10$^3$ cells were then added to the siRNA mixture. Cells were incubated for 48 hours prior to RNA purification. Two dose experiments were performed at 10 nM and 0.1 nM.

TOTAL RNA isolation using DYNABEADS mRNA Isolation Kit:

RNA was isolated using an automated protocol on a BioTek-EL406 platform using DYNABEADs (Invitrogen, cat #61012). Briefly, 70 µl of Lysis/Binding Buffer and 10 µl of lysis buffer containing 3 µl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 µl Wash Buffer A and once with Wash Buffer B. Beads were then washed with 150 µl Elution Buffer, re-captured and the supernatant was removed.

cDNA Synthesis Using ABI High Capacity cDNA Reverse Transcription Kit (Applied Biosystems, Foster City, Calif., Cat #4368813):

Ten µl of a master mix containing 1 µl 10× Buffer, 0.4 ul 25×dNTPs, 1 µl 10× Random primers, 0.5 µl Reverse Transcriptase, 0.5 µl RNase inhibitor and 6.6 µl of H$_2$O per reaction was added to RNA isolated above. Plates were sealed, mixed, and incubated on an electromagnetic shaker for 10 minutes at room temperature, followed by 2 h 37° C.

Real Time PCR:

Two µl of cDNA and 5 µl Lightcycler 480 probe master mix (Roche Cat #04887301001) were added to either 0.5 µl of Human GAPDH TaqMan Probe (4326317E) and 0.5 µl C9orf72 Human probe (Hs00376619_m1, Thermo) or 0.5 µl Mouse GAPDH TaqMan Probe (4352339E) and 0.5 µl C9orf72 Mouse probe (Mm01216837_m1, Thermo) per well in a 384 well plates (Roche cat #04887301001). Real time PCR was done in a LightCycler480 Real Time PCR system (Roche). Each duplex was tested at least two times and data were normalized to cells transfected with a non-targeting control siRNA. To calculate relative fold change, real time data were analyzed using the ΔΔCt method and normalized to assays performed with cells transfected with a non-targeting control siRNA.

Additional APP Oligonucleotide Sequences:

Table 10 through Table16B list additional modified and target APP sequences.

TABLE 10

Additional Human APP Modified Sequences

| Duplex Name | Sense Sequence (5' to 3') | SEQ ID NO | Antisense Sequence (5' to 3') | SEQ ID NO | mRNA Target sequence | SEQ ID NO |
|---|---|---|---|---|---|---|
| AD-506935.2 | asasagagCfaAfAfAfcu auucagauL96 | 1883 | asUfscugAfaUfAfguuu UfgCfucuuuscsu | 1884 | AGAAAGAGCAAAACUAUUCAGAU | 1885 |
| AD-507065.2 | ususggccAfaCfAfUfga uuagugauL96 | 1886 | asUfscacUfaAfUfcaug UfuGfgccaasgsa | 1887 | UCUUGGCCAACAUGAUUAGUGAA | 1888 |
| AD-507159.2 | uscsugggUfuGfAfCfaa auaucaauL96 | 1889 | asUfsugaUfaUfUfuguc AfaCfccagasasc | 1890 | GUUCUGGGUUGACAAAUAUCAAG | 1891 |
| AD-507538.2 | ususuaugAfuUfUfAfcu cauuaucuL96 | 1892 | asGfsauaAfuGfAfguaa AfuCfauaaasasc | 1893 | GUUUUAUGAUUUACUCAUUAUCG | 1894 |
| AD-507624.2 | asusgccuGfaAfCfUfug aauuaauuL96 | 1895 | asAfsuuaAfuUfCfaagu UfcAfggcauscsu | 1896 | AGAUGCCUGAACUUGAAUUAAUC | 1897 |
| AD-507724.2 | asgsaugcCfuGfAfAfcu ugaauuauL96 | 1898 | asUfsaauUfcAfAfguuc AfgGfcaucusasc | 1899 | GUAGAUGCCUGAACUUGAAUUAA | 1900 |
| AD-507725.2 | gscscugaAfcUfUfGfaa uuaauccuL96 | 1901 | asGfsgauUfaAfUfucaa GfuUfcaggcsasu | 1902 | AUGCCUGAACUUGAAUUAAUCCA | 1903 |
| AD-507789.2 | gsusgguuUfgUfGfAfcc caauuaauL96 | 1904 | asUfsuaaUfuGfGfguca CfaAfaccacsasa | 1905 | UUGUGGUUUGUGACCCAAUUAAG | 1906 |
| AD-507874.2 | csasgaugCfuUfUfAfga gagauuuL96 | 1907 | asAfsaauCfuCfUfcuaa AfgCfaucugsasa | 1908 | UUCAGAUGCUUUAGAGAGAUUUU | 1909 |
| AD-507928.2 | uscsuugcCfuAfAfGfua uuccuuuL96 | 1910 | asAfsaagGfaAfAfUfacuu AfgGfcaagasgsa | 1911 | UCUCUUGCCUAAGUAUUCCUUUC | 1912 |

TABLE 10-continued

Additional Human APP Modified Sequences

| Duplex Name | Sense Sequence (5' to 3') | SEQ ID NO | Antisense Sequence (5' to 3') | SEQ ID NO | mRNA Target sequence | SEQ ID NO |
|---|---|---|---|---|---|---|
| AD-507949.2 | ususgcugCfuUTCfUfgc uauauuuuL96 | 1913 | asAfsaauAfuAfGfcaga AfgCfagcaasusc | 1914 | GAUUGCUGCUUCUGCUAUAUUUG | 1915 |

Table 10 key: U = uridine-3'-phosphate, u = 2'-O-methyluridine-3'-phosphate, us = 2'-O-methyluridine-3'-phosphorothioate, a = 2'-O-methyladenosine-3'-phosphate, A = adenosine-3'-phosphate, as = 2'-O-methyladenosine-3'-phosphorothioate, (Ahd) = 2'-O-hexadecyl-adenosine-3'-phosphate, Gf = 2'-fluoroguanosine-3'-phosphate, Uf = fluorouridine-3'-phosphate, Cf = 2'-fluorocytidine-3'-phosphate, Af = 2'-fluoroadenosine-3'-phosphate, cs = 2'-O-methylcytidine-3'-phosphate, VP = Vinylphosphate 5', (Agn) = Adenosine-glycol nucleic acid (GNA), gs = 2'-O-methylguanosine-3'-phosphorothioate, (Chd) = 2'-O-hexadecyl-cytidine-3'-phosphate, (Tgn) = Thymidine-glycol nucleic acid (GNA) S-Isomer, (Ghd) = 2'-O-hexadecyl-guanosine-3'-phosphate, and cs = 2'-O-methylcytidine-3'-phosphorothioate.

TABLE 11

Additional Human APP Unmodified Sequences; NM_000484.3 and NM_201414.2 Targeting

| Duplex Name | Sense Sequence (5' to 3') | SEQ ID NO | Source Name (Range) | Antisense Sequence (5' to 3') | SEQ ID NO | Source Name (Range) | Cross Species |
|---|---|---|---|---|---|---|---|
| AD-506935.2 | AAAGAGCAAAA CUAUUCAGAU | 1916 | NM_000484.3_ 1902-1922_s (1902-1922) | AUCUGAAUAGUUUUGCUCU UUCU | 1917 | NM_201414.2_ 1675-1697_as (1900-1922) | UNK |
| AD-507065.2 | UUGGCCAACAU GAUUAGUGAU | 1918 | NM_201414.2_ 1704-1724_A21U_s (1704-1724) | AUCACUAAUCAUGUUGGCC AAGA | 1919 | NM_201414.2_ 1702-1724_U1A_as (1702-1724) | UNK |
| AD-507159.2 | UCUGGGUUGAC AAAUAUCAAU | 1920 | NM_000484.3_ 2166-2186_G21U_s (2166-2186) | AUUGAUAUUUGUCAACCCA GAAC | 1921 | NM_201414.2_ 1939-1961_C1A_as (2164-2186) | UNK |
| AD-507538.2 | UUUAUGAUUUA CUCAUUAUCU | 1922 | NM_000484.3_ 2613-2633_G21U_s (2613-2633) | AGAUAAUGAGUAAAUCAUA AAAC | 1923 | NM_201414.2_ 2386-2408_C1A_as (2611-2633) | UNK |
| AD-507624.2 | AUGCCUGAACU UGAAUUAAUU | 1924 | NM_000484.3_ 2665-2685_C21U_s (2665-2685) | AAUUAAUUCAAGUUCAGGC AUCU | 1925 | NM_201414.2_ 2438-2460_G1A_as (2663-2685) | UNK |
| AD-507724.2 | AGAUGC- CUGAAC UUGAAUUAU | 1926 | NM_201414.2_ 2438-2458_A21U_s (2438-2458) | AUAAUUCAAGUUCAGGCAU CUAC | 1927 | NM_201414.2_ 2436-2458_U1A_as (2436-2458) | UNK |
| AD-507725.2 | GCCUGAAC- UUGA AUUAAUCCU | 1928 | NM_201414.2_ 2442-2462_A21U_s (2442-2462) | AGGAUUAAUUCAAGUUCAG GCAU | 1929 | NM_201414.2_ 2440-2462_U1A_as (2440-2462) | UNK |
| AD-507789.2 | GUGGUUU- GUGAC CCAAUUAAU | 1930 | NM_000484.3_ 2853-2873_G21U_s (2853-2873) | AUUAAUUGGGUCACAAACC ACAA | 1931 | NM_201414.2_ 2626-2648_C1A_as (2851-2873) | UNK |
| AD-507874.2 | CAGAUGC- UUUAG AGAGAUUUU | 1932 | NM_000484.3_ 3006-3026_s (3006-3026) | AAAAUCUCUAAAGCAUC UGAA | 1933 | NM_201414.2_ 2779-2801_as (3004-3026) | UNK |
| AD-507928.2 | UCUUGCC- UAAGU AUUCCUUUU | 1934 | NM_201414.2_ 2718-2738_C21U_s (2718-2738) | AAAAGGAAUACUUAGGCAA GAGA | 1935 | NM_201414.2_ 2716-2738_G1A_as (2716-2738) | UNK |
| AD-507949.2 | UUGCUGC- UUCUG CUAUAUUUU | 1936 | NM_201414.2_ 2831-2851_G21U_s (2831-2851) | AAAAUAUAGCAGAAGCAGC AAUC | 1937 | NM_201414.2_ 2829-2851_C1A_as (2829-2851) | UNK |

TABLE 12

Additional Human APP Modified Sequences.

| Duplex Name | Sense Sequence (5' to 3') | SEQ ID NO | Antisense Sequence (5' to 3') | SEQ ID NO |
|---|---|---|---|---|
| AD-738012.1 | csgscuu(Uhd)CfuAfCfAfcuguauuacaL96 | 1938 | VPusGfsuaaUfaCfAfgugUfAfgAfaagcgsasu | 1939 |
| AD-738013.1 | gscsuuu(Chd)UfaCfAfCfuguauuacaaL96 | 1940 | VPusUfsguaAfuAfCfagugUfaGfaaagcsgsa | 1941 |
| AD-738014.1 | ususcua(Chd)AfcUfGfUfauuacauaaaT96 | 1942 | VPusUfsuauGfuAfAfuacaGfuGfuagaasasg | 1943 |
| AD-738015.1 | ususucu(Ahd)CfaCfUfGfuauuacauaaL96 | 1944 | VPusUfsaugUfaAfUfacagUfgUfagaaasgsc | 1945 |
| AD-738016.1 | asusuua(Ghd)CfuGfUfAfucaaacuagaL96 | 1946 | VPusCfsuagUfuUfGfauacAfgCfuaaaususc | 1947 |
| AD-738017.1 | ususccu(Ghd)AfuCfAfCfuaugcauuuaL96 | 1948 | VPusAfsaauGfcAfUfagugAfuCfaggaasasg | 1949 |
| AD-738018.1 | gsusgcu(Ghd)UfaAfCfAfcaaguagauaL96 | 1950 | VPusAfsucuAfcUfUfgugUfaCfagcacsasg | 1951 |
| AD-738019.1 | ususuag(Chd)UfgUfAfUfcaaacuaguaL96 | 1952 | VPusAfscuaGfuUfUfgauaCfaGfcuaaasusu | 1953 |
| AD-738020.1 | ususucc(Uhd)GfaUfCfAfcuaugcauuaT96 | 1954 | VPusAfsaugCfaUfAfgugaUfcAfggaaasgsg | 1955 |
| AD-738021.1 | asasugg(Ghd)UfuUfUfGfuguacuguaaL96 | 1956 | VPusUfsacaGfuAfCfacaaAfaCfccauusasa | 1957 |
| AD-738022.1 | asusugu(Ahd)CfaGfAfAfucauugcuuaL96 | 1958 | VPusAfsagcAfaUfGfauucUfgUfacaauscsa | 1959 |
| AD-738023.1 | ususgua(Chd)AfgAfAfUfcauugcuuaaL96 | 1960 | VPusUfsaagCfaAfUfgauuCfuGfuacaasusc | 1961 |
| AD-738024.1 | ususacu(Ghd)UfaCfAfGfauugcugcuaT96 | 1962 | VPusAfsgcaGfcAfAfucugUfaCfaguaasasa | 1963 |
| AD-738025.1 | asusaug(Chd)UfgAfAfGfaaguacgucaL96 | 1964 | VPusGfsacgUfaCfUfucuuCfaGfcauausug | 1965 |
| AD-738026.1 | ascscau(Uhd)GfcUfUfCfacuacccauaL96 | 1966 | VPusAfsuggGfuAfGfugaaGfcAfauggususu | 1967 |
| AD-738027.1 | csusgug(Chd)UfgUfAfAfcacaaguagaL96 | 1968 | VPusCfsuacUfuGfUfguuaCfaGfcacagscsu | 1969 |
| AD-738028.1 | usgscug(Uhd)AfaCfAfCfaaguagaugaL96 | 1970 | VPusCfsaucUfaCfUfugugUfuAfcagcascsa | 1971 |
| AD-738029.1 | ascsagc(Uhd)GfuGfCfUfguaacacaaaT96 | 1972 | VPusUfsuguGfuUfAfcagcAfcAfgcuguscsa | 1973 |
| AD-738030.1 | gscsugu(Ahd)AfcAfCfAfaguagaugcaL96 | 1974 | VPusGfscauCfuAfCfuuguGfuUfacagcsasc | 1975 |
| AD-738031.1 | uscsaaa(Chd)UfaGfUfGfcaugaauagaL96 | 1976 | VPusCfsuauUfcAfUfgcacUfaGfuuugasusa | 1977 |
| AD-738032.1 | csasaac(Uhd)AfgUfGfCfaugaauagaaL96 | 1978 | VPusUfscuaUfuCfAfugcaCfuAfguuugsasu | 1979 |
| AD-738033.1 | usgscag(Ghd)AfuGfAfUfuguacagaaaL96 | 1980 | VPusUfsucuGfuAfCfaaucAfuCfcugcasgsa | 1981 |
| AD-738034.1 | gscsagg(Ahd)UfgAfUfUfguacagaauaT96 | 1982 | VPusAfsuucUfgUfAfcaauCfaUfccugcsasg | 1983 |
| AD-738035.1 | csasgga(Uhd)GfaUfUfGfuacagaaucaL96 | 1984 | VPusGfsauuCfuGfUfacaaUfcAfuccugscsa | 1985 |
| AD-738036.1 | usasuca(Ahd)AfcUfAfGfugcaugaauaT96 | 1986 | VPusAfsuucAfuGfCfacuaGfuUfugauascsa | 1987 |
| AD-738037.1 | ususugu(Ghd)CfcUfGfUfuuuaugugcaL96 | 1988 | VPusGfscacAfuAfAfaacaGfgCfacaaasgsa | 1989 |
| AD-738038.1 | ususgug(Chd)CfuGfUfUfuuaugugcaaL96 | 1990 | VPusUfsgcaCfaUfAfaaacAfgGfcacaasasg | 1991 |
| AD-738039.1 | csusgca(Ghd)GfaUfGfAfuuguacagaaL96 | 1992 | VPusUfscugUfaCfAfaucaUfcCfugcagsasa | 1993 |
| AD-738040.1 | csasggu(Chd)AfuGfAfGfagaaugggaaL96 | 1994 | VPusUfscccAfuUfCfucucAfuGfaccugsgsg | 1995 |
| AD-738041.1 | usasugu(Ghd)CfaCfAfCfauuaggcauaL96 | 1996 | VPusAfsugcCfuAfAfugugUfgCfacauasasa | 1997 |
| AD-738042.1 | usgsugc(Ahd)CfaCfAfUfuaggcauugaL96 | 1998 | VPusCfsaauGfcCfUfaaugUfgUfgcacasusa | 1999 |
| AD-738043.1 | gsgsaug(Ahd)UfuGfUfAfcagaaucauaT96 | 2000 | VPusAfsugaUfuCfUfguacAfaUfcauccsusg | 2001 |
| AD-738044.1 | ascscau(Chd)CfaGfAfAfcuggugcaaaL96 | 2002 | VPusUfsugcAfcCfAfguucUfgGfauggscsa | 2003 |
| AD-738045.1 | usasugc(Uhd)GfaAfGfAfaguacguccaL96 | 2004 | VPusGfsgacGfuAfCfuucuUfcAfgcauasusu | 2005 |
| AD-738046.1 | asusgcu(Ghd)AfaAfAfAfguacguccgaL96 | 2006 | VPusCfsggaCfgUfAfcuucUfuCfagcausasu | 2007 |
| AD-738047.1 | asasacc(Ahd)UfuGfCfUfucacuacccaL96 | 2008 | VPusGfsgguAfgUfGfaagcAfaUfgguuususg | 2009 |
| AD-738048.1 | asascca(Uhd)UfgCfUfUfcacuacccaaL96 | 2010 | VPusUfsgggUfaGfUfgaagCfaAfugguususu | 2011 |
| AD-397217.2 | csasccg(Ahd)GfaGfAfGfaaugucccaaL96 | 2012 | VPusUfsgggAfcAfUfucucUfcUfcggugscsu | 2013 |

TABLE 12-continued

Additional Human APP Modified Sequences.

| Duplex Name | Sense Sequence (5' to 3') | SEQ ID NO | Antisense Sequence (5' to 3') | SEQ ID NO |
|---|---|---|---|---|
| AD-738049.1 | gsusugu(Ahd)UfaUfUfAfuucuuguggaL96 | 2014 | VPusCfscacAfaGfAfauaaUfaUfacaacsusg | 2015 |
| AD-738050.1 | ususaug(Uhd)GfcAfCfAfcauuaggcaaL96 | 2016 | VPusUfsgccUfaAfUfguguGfcAfcauaasasa | 2017 |
| AD-738051.1 | asusgug(Chd)AfcAfCfAfuuaggcauuaL96 | 2018 | VPusAfsaugCfcUfAfauguGfuGfcacausasa | 2019 |
| AD-738052.1 | gsusgca(Chd)AfcAfUfUfaggcauugaaT96 | 2020 | VPusUfscaaUfgCfCfuaauGfuGfugcacsasu | 2021 |
| AD-738053.1 | usgsauu(Ghd)UfaCfAfGfaaucauugcaL96 | 2022 | VPusGfscaaUfgAfUfucugUfaCfaaucasusc | 2023 |
| AD-738054.1 | gscsuuc(Ahd)CfuAfCfCfcaucggucuaL96 | 2024 | VPusAfscacCfgAfUfggguAfgUfgaagcsasa | 2025 |
| AD-738055.1 | ususuua(Uhd)GfuGfCfAfcacauuaggaL96 | 2026 | VPusCfscuaAfuGfUfgugcAfcAfuaaaascsa | 2027 |
| AD-738056.1 | csgscuu(Uhd)CfuAfCfAfcuguauuacaL96 | 2028 | VPusGfsuaau(Agn)caguguAfgAfaagcgsasu | 2029 |
| AD-738057.1 | gscsuuu(Chd)UfaCfAfCfcuguauuacaL96 | 2030 | VPusUfsguaa(Tgn)acagugUfaGfaaagcsgsa | 2031 |
| AD-738058.1 | ususcua(Chd)AfcUfGfUfauuacauaaT96 | 2032 | VPusUfsuaug(Tgn)aauacaGfuGfuagaasasg | 2033 |
| AD-738059.1 | ususucu(Ahd)CfaCfUfGfuauuacauaaL96 | 2034 | VPusUfsaugu(Agn)auacagUfgUfagaaasgsc | 2035 |
| AD-738060.1 | asusuua(Ghd)CfuGfUfAfucaaacuagaL96 | 2036 | VPusCfsuagu(Tgn)ugauacAfgCfuaaaususc | 2037 |
| AD-738061.1 | ususccu(Ghd)AfuCfAfCfuaugcauuuaL96 | 2038 | VPusAfsaaug(Cgn)auagugAfuCfaggaasasg | 2039 |
| AD-738062.1 | gsusgcu(Ghd)UfaAfCfAfcaaguagauaL96 | 2040 | VPusAfsucua(Cgn)uuguguUfaCfagcacsasg | 2041 |
| AD-738063.1 | ususuag(Chd)UfgUfAfUfcaaacuaguaL96 | 2042 | VPusAfscuag(Tgn)uugauaCfaGfcuaaasusu | 2043 |
| AD-738064.1 | ususucc(Uhd)GfaUfCfAfcuaugcauuaT96 | 2044 | VPusAfsaugc(Agn)uagugaUfcAfggaaasgsg | 2045 |
| AD-738065.1 | asasugg(Ghd)UfuUfUfGfguguacuguaaL96 | 2046 | VPusUfsacag(Tgn)acacaaAfaCfccauusasa | 2047 |
| AD-738066.1 | ususacu(Ghd)UfaCfAfGfauugcugcuaT96 | 2048 | VPusAfsgcag(Cgn)aaucugUfaCfaguaasasa | 2049 |
| AD-738067.1 | asusugu(Ahd)CfaGfAfAfucauugcuuaL96 | 2050 | VPusAfsagca(Agn)ugauucUfgUfacaauscsa | 2051 |
| AD-738068.1 | ususgua(Chd)AfgAfAfUfcauugcuuaaL96 | 2052 | VPusUfsaagc(Agn)augauuCfuGfuacaas

TABLE 12-continued

Additional Human APP Modified Sequences.

| Duplex Name | Sense Sequence (5' to 3') | SEQ ID NO | Antisense Sequence (5' to 3') | SEQ ID NO |
|---|---|---|---|---|
| AD-738087.1 | asasacc(Ahd)UfuGfCfUfucacuacccaL96 | 2090 | VPusGfsggua(Ggn)ugaagcAfaUfgguuususg | 2091 |
| AD-738088.1 | asascca(Uhd)UfgCfUfUfcacuacccaaL96 | 2092 | VPusUfsgggu(Agn)gugaagcCfaAfugguususu | 2093 |
| AD-738089.1 | usasugu(Ghd)CfaCfAfCfauuaggcauaL96 | 2094 | VPusAfsugcc(Tgn)aaugugUfgCfacauasasa | 2095 |
| AD-738090.1 | usgsugc(Ahd)CfaCfAfUfuaggcauugaL96 | 2096 | VPusCfsaaug(Cgn)cuaaugUfgUfgcacasusa | 2097 |
| AD-738091.1 | gsgsaug(Ahd)UfuGfUfAfcagaaucauaT96 | 2098 | VPusAfsugau(Tgn)cuguacAfaUfcauccsusg | 2099 |
| AD-738092.1 | ascscau(Chd)CfaGfAfAfcuggugcaaaL96 | 2100 | VPusUfsugca(Cgn)caguucUfgGfauggusesa | 2101 |
| AD-738093.1 | csasccg(Ahd)GfaGfAfGfaaugucccaaL96 | 2102 | VPusUfsggga(Cgn)auucucUfcUfcggugscsu | 2103 |
| AD-738094.1 | gsusugu(Ahd)UfaUfUfAfuucuuguggaL96 | 2104 | VPusCfscaca(Agn)gaauaaUfaUfacaacsusg | 2105 |
| AD-738095.1 | ususaug(Uhd)GfcAfCfAfcauuaggcaaL96 | 2106 | VPusUfsgccu(Agn)augugUfcAfcauaasasa | 2107 |
| AD-738096.1 | asusgug(Chd)AfcAfCfAfuuaggcauuaL96 | 2108 | VPusAfsaugc(Cgn)uaaugUfgUfcacausasa | 2109 |
| AD-738097.1 | gsusgca(Chd)AfcAfUfUfaggcauugaaT96 | 2110 | VPusUfscaau(Ggn)ccuaauGfuGfugcacsasu | 2111 |
| AD-738098.1 | usgsauu(Ghd)UfaCfAfGfaaucauugcaL96 | 2112 | VPusGfscaau(Ggn)auucugUfaCfaaucasusc | 2113 |
| AD-738099.1 | gscsuuc(Ahd)CfuAfCfCfcaucggugaL96 | 2114 | VPusAfscacc(Ggn)augggUAfgUfgaagcsasa | 2115 |
| AD-738100.1 | ususuua(Uhd)GfuGfCfAfcacauuaggaL96 | 2116 | VPusCfscuaa(Tgn)gugugcAfcAfuaaaascsa | 2117 |

Table 12 key: U = uridine-3'-phosphate, u = 2'-O-methyluridine-3'-phosphate, us = 2'-O-methyluridine-3'-phosphorothioate, a = 2'-O-methyladenosine-3'-phosphate, A = adenosine-3'-phosphate, as = 2'-O-methyladenosine-3'-phosphorothioate, (Ahd) = 2'-O-hexadecyl-adenosine-3'-phosphate, Gf = 2'-fluoroguanosine-3'-phosphate, Uf = fluorouridine-3'-phosphate, Cf = 2'-fluorocytidine-3'-phosphate, Af = 2'-fluoroadenosine-3'-phosphate, cs = 2'-O-methylcytidine-3'-phosphate, VP = Vinylphosphate 5', (Agn) = Adenosine-glycol nucleic acid (GNA), gs = 2'-O-methylguanosine-3'-phosphorothioate, (Chd) = 2'-O-hexadecyl-cytidine-3'-phosphate, (Tgn) = Thymidine-glycol nucleic acid (GNA) S-Isomer, (Ghd) = 2'-O-hexadecyl-guanosine-3'-phosphate, and cs = 2'-O-methylcytidine-3'-phosphorothioate.

TABLE 13

Additional Human APP Unmodified Sequences; XM_005548887.2 and NM_001198823.1 Targeting.

| Duplex Name | Sense Sequence (5' to 3') | SEQ ID NO | Antisense Sequence (5' to 3') | SEQ ID NO | Source Name |
|---|---|---|---|---|---|
| AD-738012.1 | CGCUUUCUACACUGUAUUACA | 2118 | UGUAAUACAGUGUAGAAAGCGAU | 2119 | XM_005548887.2_3401-3423_as |
| AD-738013.1 | GCUUUCUACACUGUAUUACAA | 2120 | UUGUAAUACAGUGUAGAAAGCGA | 2121 | XM_005548887.2_3402-3424_as |
| AD-738014.1 | UUCUACACUGUAUUACAUAAA | 2122 | UUUAUGUAAUACAGUGUAGAAAG | 2123 | NM_001198823.1_3306-3328_as |
| AD-738015.1 | UUUCUACACUGUAUUACAUAA | 2124 | UUAUGUAAUACAGUGUAGAAAGC | 2125 | NM_001198823.1_3305-3327_as |
| AD-738016.1 | AUUUAGCUGUAUCAAACUAGA | 2126 | UCUAGUUUGAUACAGCUAAAUUC | 2127 | XM_005548887.2_2837-2859_as |
| AD-738017.1 | UUCCUGAUCACUAUGCAUUUA | 2128 | UAAAUGCAUAGUGAUCAGGAAAG | 2129 | XM_005548887.2_3030-3052_as |
| AD-738018.1 | GUGCUGUAACAAGUAGAUA | 2130 | UAUCUACUUGUUACAGCACAG | 2131 | NM_001198823.1_2602-2624_C1A_as |
| AD-738019.1 | UUUAGCUGUAUCAAACUAGUA | 2132 | UACUAGUUUGAUACAGCUAAAUU | 2133 | XM_005548887.2_2838-2860_as |
| AD-738020.1 | UUUCCUGAUCACUAUGCAUUA | 2134 | UAAUGCAUAGUGAUCAGGAAAGG | 2135 | XM_005548887.2_3029-3051_as |

TABLE 13-continued

Additional Human APP Unmodified Sequences;
XM_005548887.2 and NM_001198823.1 Targeting.

| Duplex Name | Sense Sequence (5' to 3') | SEQ ID NO | Antisense Sequence (5' to 3') | SEQ ID NO | Source Name |
|---|---|---|---|---|---|
| AD-738021.1 | AAUGGGUUUUGUGUACUGUAA | 2136 | UUACAGUACACAAAACCCAUUAA | 2137 | XM_005548887.2_2813-2835_as |
| AD-738022.1 | AUUGUACAGAAUCAUUGCUUA | 2138 | UAAGCAAUGAUUCUGUACAAUCA | 2139 | NM_001198823.1_3272-3294_as |
| AD-738023.1 | UUGUACAGAAUCAUUGCUUAA | 2140 | UUAAGCAAUGAUUCUGUACAAUC | 2141 | NM_001198823.1_3273-3295_as |
| AD-738024.1 | UUACUGUACAGAUUGCUGCUA | 2142 | UAGCAGCAAUCUGUACAGUAAAA | 2143 | XM_005548887.2_3113-3135_as |
| AD-738025.1 | AUAUGCUGAAGAAGUACGUCA | 2144 | UGACGUACUUCUUCAGCAUAUUG | 2145 | XM_005548887.2_1740-1762_as |
| AD-738026.1 | ACCAUUGCUUCACUACCCAUA | 2146 | UAUGGGUAGUGAAGCAAUGGUUU | 2147 | NM_001198823.1_2506-2528_G1A_as |
| AD-738027.1 | CUGUGCUGUAACACAAGUAGA | 2148 | UCUACUUGUGUUACAGCACAGCU | 2149 | NM_001198823.1_2600-2622_as |
| AD-738028.1 | UGCUGUAACACAAGUAGAUGA | 2150 | UCAUCUACUUGUGUUACAGCACA | 2151 | NM_001198823.1_2603-2625_G1A_as |
| AD-738029.1 | ACAGCUGUGCUGUAACACAAA | 2152 | UUUGUGUUACAGCACAGCUGUCA | 2153 | NM_001198823.1_2596-2618_C1A_as |
| AD-738030.1 | GCUGUAACACAAGUAGAUGCA | 2154 | UGCAUCUACUUGUGUUACAGCAC | 2155 | NM_001198823.1_2604-2626_G1A_as |
| AD-738031.1 | UCAAACUAGUGCAUGAAUAGA | 2156 | UCUAUUCAUGCACUAGUUUGAUA | 2157 | NM_001198823.1_2742-2764_as |
| AD-738032.1 | CAAACUAGUGCAUGAAUAGAA | 2158 | UUCUAUUCAUGCACUAGUUUGAU | 2159 | NM_001198823.1_2743-2765_as |
| AD-738033.1 | UGCAGGAUGAUUGUACAGAAA | 2160 | UUUCUGUACAAUCAUCCUGCAGA | 2161 | NM_001198823.1_3263-3285_as |
| AD-738034.1 | GCAGGAUGAUUGUACAGAAUA | 2162 | UAUUCUGUACAAUCAUCCUGCAG | 2163 | NM_001198823.1_3264-3286_G1A_as |
| AD-738035.1 | CAGGAUGAUUGUACAGAAUCA | 2164 | UGAUUCUGUACAAUCAUCCUGCA | 2165 | NM_001198823.1_3265-3287_as |
| AD-738036.1 | UAUCAAACUAGUGCAUGAAUA | 2166 | UAUUCAUGCACUAGUUUGAUACA | 2167 | NM_001198823.1_2740-2762_as |
| AD-738037.1 | UUUGUGCCUGUUUUAUGUGCA | 2168 | UGCACAUAAAACAGGCACAAAGA | 2169 | NM_001198823.1_3070-3092_as |
| AD-738038.1 | UUGUGCCUGUUUUAUGUGCAA | 2170 | UUGCACAUAAAACAGGCACAAAG | 2171 | NM_001198823.1_3071-3093_G1A_as |
| AD-738039.1 | CUGCAGGAUGAUUGUACAGAA | 2172 | UUCUGUACAAUCAUCCUGCAGAA | 2173 | NM_001198823.1_3262-3284_as |
| AD-738040.1 | CAGGUCAUGAGAGAAUGGGAA | 2174 | UUCCCAUUCUCUCAUGACCUGGG | 2175 | NM_001198823.1_1369-1391_as |
| AD-738041.1 | UAUGUGCACACAUUAGGCAUA | 2176 | UAUGCCUAAUGUGUGCACAUAAA | 2177 | NM_001198823.1_3083-3105_as |
| AD-738042.1 | UGUGCACACAUUAGGCAUUGA | 2178 | UCAAUGCCUAAUGUGUGCACAUA | 2179 | NM_001198823.1_3085-3107_as |
| AD-738043.1 | GGAUGAUUGUACAGAAUCAUA | 2180 | UAUGAUUCUGUACAAUCAUCCUG | 2181 | NM_001198823.1_3267-3289_as |
| AD-738044.1 | ACCAUCCAGAACUGGUGCAAA | 2182 | UUUGCACCAGUUCUGGAUGGUCA | 2183 | NM_001198823.1_424-446_C1A_as |
| AD-738045.1 | UAUGCUGAAGAAGUACGUCCA | 2184 | UGGACGUACUUCUUCAGCAUAUU | 2185 | XM_005548887.2_1741-1763_as |

TABLE 13-continued

Additional Human APP Unmodified Sequences;
XM_005548887.2 and NM_001198823.1 Targeting.

| Duplex Name | Sense Sequence (5' to 3') | SEQ ID NO | Antisense Sequence (5' to 3') | SEQ ID NO | Source Name |
|---|---|---|---|---|---|
| AD-738046.1 | AUGCUGAAGAAGUACGUCCGA | 2186 | UCGGACGUACUUCUUCAGCAUAU | 2187 | XM_005548887.2_1742-1764_as |
| AD-738047.1 | AAACCAUUGCUUCACUACCCA | 2188 | UGGGUAGUGAAGCAAUGGUUUUG | 2189 | XM_005548887.2_2614-2636_as |
| AD-738048.1 | AACCAUUGCUUCACUACCCAA | 2190 | UUGGGUAGUGAAGCAAUGGUUUU | 2191 | XM_005548887.2_2615-2637_as |
| AD-397217.2 | CACCGAGAGAGAAUGUCCCAA | 2192 | UUGGGACAUUCUCUCUCGGUGCU | 2193 | NM_001198823.1_1351-1373_C1A_as |
| AD-738049.1 | GUUGUAUAUUAUUCUUGUGGA | 2194 | UCCACAAGAAUAAUAUACAACUG | 2195 | XM_005548887.2_2906-2928_as |
| AD-738050.1 | UUAUGUGCACACAUUAGGCAA | 2196 | UUGCCUAAUGUGUGCACAUAAAA | 2197 | NM_001198823.1_3082-3104_as |
| AD-738051.1 | AUGUGCACACAUUAGGCAUUA | 2198 | UAAUGCCUAAUGUGUGCACAUAA | 2199 | NM_001198823.1_3084-3106_C1A_as |
| AD-738052.1 | GUGCACACAUUAGGCAUUGAA | 2200 | UUCAAUGCCUAAUGUGUGCACAU | 2201 | NM_001198823.1_3086-3108_C1A_as |
| AD-738053.1 | UGAUUGUACAGAAUCAUUGCA | 2202 | UGCAAUGAUUCUGUACAAUCAUC | 2203 | NM_001198823.1_3270-3292_as |
| AD-738054.1 | GCUUCACUACCCAUCGGUGUA | 2204 | UACACCGAUGGGUAGUGAAGCAA | 2205 | NM_001198823.1_2512-2534_as |
| AD-738055.1 | UUUUAUGUGCACACAUUAGGA | 2206 | UCCUAAUGUGUGCACAUAAAACA | 2207 | NM_001198823.1_3080-3102_G1A_as |
| AD-738056.1 | CGCUUUCUACACUGUAUUACA | 2208 | UGUAAUACAGUGUAGAAAGCGAU | 2209 | XM_005548887.2_3401-3423_as |
| AD-738057.1 | GCUUUCUACACUGUAUUACAA | 2210 | UUGUAAUACAGUGUAGAAAGCGA | 2211 | XM_005548887.2_3402-3424_as |
| AD-738058.1 | UUCUACACUGUAUUACAUAAA | 2212 | UUUAUGUAAUACAGUGUAGAAAG | 2213 | XM_005548887.2_3405-3427_as |
| AD-738059.1 | UUUCUACACUGUAUUACAUAA | 2214 | UUAUGUAAUACAGUGUAGAAAGC | 2215 | XM_005548887.2_3404-3426_as |
| AD-738060.1 | AUUUAGCUGUAUCAAACUAGA | 2216 | UCUAGUUGAUACAGCUAAAUUC | 2217 | XM_005548887.2_2837-2859_as |
| AD-738061.1 | UUCCUGAUCACUAUGCAUUUA | 2218 | UAAAUGCAUAGUGAUCAGGAAAG | 2219 | XM_005548887.2_3030-3052_as |
| AD-738062.1 | GUGCUGUAACACAAGUAGAUA | 2220 | UAUCUACUUGUGUUACAGCACAG | 2221 | XM_005548887.2_2716-2738_as |
| AD-738063.1 | UUUAGCUGUAUCAAACUAGUA | 2222 | UACUAGUUGAUACAGCUAAAUU | 2223 | XM_005548887.2_2838-2860_as |
| AD-738064.1 | UUUCCUGAUCACUAUGCAUUA | 2224 | UAAUGCAUAGUGAUCAGGAAAGG | 2225 | XM_005548887.2_3029-3051_as |
| AD-738065.1 | AAUGGGUUUUGUGUACUGUAA | 2226 | UUACAGUACACAAAACCCAUUAA | 2227 | XM_005548887.2_2813-2835_as |
| AD-738066.1 | UUACUGUACAGAUUGCUGCUA | 2228 | UAGCAGCAAUCUGUACAGUAAAA | 2229 | XM_005548887.2_3113-3135_as |
| AD-738067.1 | AUUGUACAGAAUCAUUGCUUA | 2230 | UAAGCAAUGAUUCUGUACAAUCA | 2231 | XM_005548887.2_3371-3393_as |
| AD-738068.1 | UUGUACAGAAUCAUUGCUUAA | 2232 | UUAAGCAAUGAUUCUGUACAAUC | 2233 | XM_005548887.2_3372-3394_as |
| AD-738069.1 | AUAUGCUGAAGAAGUACGUCA | 2234 | UGACGUACUUCUUCAGCAUAUUG | 2235 | XM_005548887.2_1740-1762_as |

TABLE 13-continued

Additional Human APP Unmodified Sequences;
XM_005548887.2 and NM_001198823.1 Targeting.

| Duplex Name | Sense Sequence (5' to 3') | SEQ ID NO | Antisense Sequence (5' to 3') | SEQ ID NO | Source Name |
|---|---|---|---|---|---|
| AD-738070.1 | ACCAUUGCUUCACUACCCAUA | 2236 | UAUGGGUAGUGAAGCAAUGGUUU | 2237 | XM_005548887.2_2616-2638_as |
| AD-738071.1 | CUGUGCUGUAACACAAGUAGA | 2238 | UCUACUTGUGUUACAGCACAGCU | 2239 | XM_005548887.2_2714-2736_as |
| AD-738072.1 | UGCUGUAACACAAGUAGAUGA | 2240 | UCAUCUACUUGUGUUACAGCACA | 2241 | XM_005548887.2_2717-2739_as |
| AD-738073.1 | ACAGCUGUGCUGUAACACAAA | 2242 | UUUGUGTUACAGCACAGCUGUCA | 2243 | XM_005548887.2_2710-2732_as |
| AD-738074.1 | GCUGUAACACAAGUAGAUGCA | 2244 | UGCAUCUACUUGUGUUACAGCAC | 2245 | XM_005548887.2_2718-2740_as |
| AD-738075.1 | UCAAACUAGUGCAUGAAUAGA | 2246 | UCUAUUCAUGCACUAGUUUGAUA | 2247 | XM_005548887.2_2848-2870_as |
| AD-738076.1 | CAAACUAGUGCAUGAAUAGAA | 2248 | UUCUAUTCAUGCACUAGUUUGAU | 2249 | XM_005548887.2_2849-2871_as |
| AD-738077.1 | UGCAGGAUGAUUGUACAGAAA | 2250 | UUUCUGTACAAUCAUCCUGCAGA | 2251 | XM_005548887.2_3362-3384_as |
| AD-738078.1 | GCAGGAUGAUUGUACAGAAUA | 2252 | UAUUCUGUACAAUCAUCCUGCAG | 2253 | XM_005548887.2_3363-3385_as |
| AD-738079.1 | CAGGAUGAUUGUACAGAAUCA | 2254 | UGAUUCTGUACAAUCAUCCUGCA | 2255 | XM_005548887.2_3364-3386_as |
| AD-738080.1 | UAUCAAACUAGUGCAUGAAUA | 2256 | UAUUCATGCACUAGUUUGAUACA | 2257 | XM_005548887.2_2846-2868_as |
| AD-738081.1 | UUUGUGCCUGUUUUAUGUGCA | 2258 | UGCACAUAAAACAGGCACAAAGA | 2259 | XM_005548887.2_3180-3202_as |
| AD-738082.1 | UUGUGCCUGUUUUAUGUGCAA | 2260 | UUGCACAUAAAACAGGCACAAAG | 2261 | XM_005548887.2_3181-3203_as |
| AD-738083.1 | CUGCAGGAUGAUUGUACAGAA | 2262 | UUCUGUACAAUCAUCCUGCAGAA | 2263 | XM_005548887.2_3361-3383_as |
| AD-738084.1 | CAGGUCAUGAGAGAAUGGGAA | 2264 | UUCCCAUUCUCUCAUGACCUGGG | 2265 | XM_005548887.2_1487-1509_as |
| AD-738085.1 | UAUGCUGAAGAAGUACGUCCA | 2266 | UGGACGTACUUCUUCAGCAUAUU | 2267 | XM_005548887.2_1741-1763_as |
| AD-738086.1 | AUGCUGAAGAAGUACGUCCGA | 2268 | UCGGACGUACUUCUUCAGCAUAU | 2269 | XM_005548887.2_1742-1764_as |
| AD-738087.1 | AAACCAUUGCUUCACUACCCA | 2270 | UGGGUAGUGAAGCAAUGGUUUUG | 2271 | XM_005548887.2_2614-2636_as |
| AD-738088.1 | AACCAUUGCUUCACUACCCAA | 2272 | UUGGGUAGUGAAGCAAUGGUUUU | 2273 | XM_005548887.2_2615-2637_as |
| AD-738089.1 | UAUGUGCACACAUUAGGCAUA | 2274 | UAUGCCUAAUGUGUGCACAUAAA | 2275 | XM_005548887.2_3193-3215_as |
| AD-738090.1 | UGUGCACACAUUAGGCAUUGA | 2276 | UCAAUGCCUAAUGUGUGCACAUA | 2277 | XM_005548887.2_3195-3217_as |
| AD-738091.1 | GGAUGAUUGUACAGAAUCAUA | 2278 | UAUGAUUCUGUACAAUCAUCCUG | 2279 | XM_005548887.2_3366-3388_as |
| AD-738092.1 | ACCAUCCAGAACUGGUGCAAA | 2280 | UUUGCACCAGUUCUGGAUGGUCA | 2281 | XM_005548887.2_767-789_as |
| AD-738093.1 | CACCGAGAGAGAAUGUCCCAA | 2282 | UUGGGACAUUCUCUCUCGGUGCU | 2283 | XM_005548887.2_1469-1491_as |
| AD-738094.1 | GUUGUAUAUUAUUCUUGUGGA | 2284 | UCCACAAGAAUAAUAUACAACUG | 2285 | XM_005548887.2_2906-2928_as |

TABLE 13-continued

Additional Human APP Unmodified Sequences;
XM 005548887.2 and NM 001198823.1 Targeting.

| Duplex Name | Sense Sequence (5' to 3') | SEQ ID NO | Antisense Sequence (5' to 3') | SEQ ID NO | Source Name |
|---|---|---|---|---|---|
| AD-738095.1 | UUAUGUGCACACAUUAGGCAA | 2286 | UUGCCUAAUGUGUGCACAUAAAA | 2287 | XM_005548887.2_3192-3214_as |
| AD-738096.1 | AUGUGCACACAUUAGGCAUUA | 2288 | UAAUGCCUAAUGUGUGCACAUAA | 2289 | XM_005548887.2_3194-3216_as |
| AD-738097.1 | GUGCACACAUUAGGCAUUGAA | 2290 | UUCAAUGCCUAAUGUGUGCACAU | 2291 | XM_005548887.2_3196-3218_as |
| AD-738098.1 | UGAUUGUACAGAAUCAUUGCA | 2292 | UGCAAUGAUUCUGUACAAUCAUC | 2293 | XM_005548887.2_3369-3391_as |
| AD-738099.1 | GCUUCACUACCCAUCGGUGUA | 2294 | UACACCGAUGGGUAGUGAAGCAA | 2295 | XM_005548887.2_2622-2644_as |
| AD-738100.1 | UUUUAUGUGCACACAUUAGGA | 2296 | UCCUAAUGUGUGCACAUAAAACA | 2297 | XM_005548887.2_3190-3212_as |

TABLE 14

Additional Human APP Modified Sequences.

| Target | Duplex Name | Sense Sequence (5' to 3') | SEQ ID NO | Antisense Sequence (5' to 3') | SEQ ID NO |
|---|---|---|---|---|---|
| APP | AD-886823.1 | usasgug(Chd)AfuGfAfAfuagauucucaL96 | 2298 | VPusGfsagaa(Tgn)cuauucAfuGfcacuasgsu | 2299 |
| APP | AD-886824.1 | usasgug(Chd)AfugAfAfuagauucucaL96 | 2300 | VPusGfsagaa(Tgn)cuauucAfuGfcacuasgsu | 2301 |
| APP | AD-886825.1 | usasgug(Chd)AfudGAfAfuagauucucaL96 | 2302 | VPusGfsagaa(Tgn)cuauucAfuGfcacuasgsu | 2303 |
| APP | AD-886826.1 | usasgug(Chd)AfudGadAuagauucucaL96 | 2304 | VPusGfsagaa(Tgn)cuaulfcAfuGfcacuasgsu | 2305 |
| APP | AD-886827.1 | usasgug(Chd)AfuGfAfAfuagauucucaL96 | 2306 | VPusdGsagaa(Tgn)cuauucAfuGfcacuasgsu | 2307 |
| APP | AD-886828.1 | usasgug(Chd)AfuGfAfAfuagauucucaL96 | 2308 | VPusGfsagaa(Tgn)cuauucAfugcacuasgsu | 2309 |
| APP | AD-886829.1 | usasgug(Chd)AfuGfAfAfuagauucucaL96 | 2310 | VPusGfsagaa(Tgn)cuauucAfudGcacuasgsu | 2311 |
| APP | AD-886830.1 | usasgug(Chd)AfuGfaAfuagauucucaL96 | 2312 | VPusGfsagaa(Tgn)cuaudTcAfudGcacuasgsu | 2313 |
| APP | AD-886831.1 | usasgug(Chd)AfuGfaAfuagauucucaL96 | 2314 | VPusGfsagaa(Tgn)cuaudTcAfugcacuasgsu | 2315 |
| APP | AD-886832.1 | usasgug(Chd)AfuGfAfAfuagauucucaL96 | 2316 | VPusdGsagaa(Tgn)cuauucAfudGcacuasgsu | 2317 |
| APP | AD-886833.1 | usasgug(Chd)AfuGfaAfuagauucucaL96 | 2318 | VPusdGsagaa(Tgn)cuaudTcAfudGcacuasgsu | 2319 |
| APP | AD-886834.1 | usasgug(Chd)AfudGAfAfuagauucucaL96 | 2320 | VPusdGsagaa(Tgn)cuauucAfuGfcacuasgsu | 2321 |
| APP | AD-886836.1 | usasgug(Chd)AfudGAfAfuagauucucaL96 | 2322 | VPusGfsagaa(Tgn)cuauucAfudGcacuasgsu | 2323 |
| APP | AD-886837.1 | usasgug(Chd)AfudGaAfuagauucucaL96 | 2324 | VPusGfsagaa(Tgn)cuaudTcAfudGcacuasgsu | 2325 |
| APP | AD-886838.1 | usasgug(Chd)AfudGaAfuagauucucaL96 | 2326 | VPusGfsagaa(Tgn)cuaudTcAfugcacuasgsu | 2327 |

TABLE 14-continued

Additional Human APP Modified Sequences.

| Target | Duplex Name | Sense Sequence (5' to 3') | SEQ ID NO | Antisense Sequence (5' to 3') | SEQ ID NO |
|---|---|---|---|---|---|
| APP | AD-886839.1 | usasgug(Chd)AfudGAfAfuagauucucaL96 | 2328 | VPusdGsagaa(Tgn)cuauucAfudGcacuasgsu | 2329 |
| APP | AD-886839.2 | usasgug(Chd)AfudGAfAfuagauucucaL96 | 2330 | VPusdGsagaa(Tgn)cuauucAfudGcacuasgsu | 2331 |
| APP | AD-886840.1 | usasgug(Chd)AfudGAfAfuagauucucaL96 | 2332 | VPusdGsagaa(Tgn)cuaudTcAfudGcacuasgsu | 2333 |
| APP | AD-886841.1 | usasgug(Chd)AfudGaAfuagauucucaL96 | 2334 | VPusdGsagaa(Tgn)cuaudTcAfudGcacuasgsu | 2335 |
| APP | AD-886842.1 | usasgug(Chd)AfudGadAuagauucucaL96 | 2336 | VPusdGsagaa(Tgn)cuaudTcAfudGcacuasgsu | 2337 |
| APP | AD-886843.1 | usasgug(Chd)audGadAuagauucucaL96 | 2338 | VPusdGsagaa(Tgn)cuaudTcAfudGcacuasgsu | 2339 |
| APP | AD-886844.1 | usasgug(Chd)audGadAuagauucucaL96 | 2340 | VPudGagaa(Tgn)cuaudTcAfudGcacuasgsu | 2341 |
| APP | AD-886845.1 | usasgug(Chd)audGadAuagauucucaL96 | 2342 | VPudGagaa(Tgn)cuauUfcAfudGcacuasgsu | 2343 |
| APP | AD-886846.1 | usasgug(Chd)audGadAuagauucucaL96 | 2344 | VPudGadGadAucuauUfcAfudGcacuasgsu | 2345 |
| APP | AD-886847.1 | usasgug(Chd)AfudGAfAfuagauucucaL96 | 2346 | VPudGagaa(Tgn)cuauucAfudGcacuasgsu | 2347 |
| APP | AD-886848.1 | usasgug(Chd)AfudGAfAfuagauucucaL96 | 2348 | VPusdGsagadA(Tgn)cuauucAfudGcacuasgsu | 2349 |
| APP | AD-886849.1 | usasgug(Chd)AfudGAfAfuagauucucaL96 | 2350 | VPusdGsagdAa(Tgn)cuauucAfudGcacuasgsu | 2351 |
| APP | AD-886850.1 | usasgug(Chd)AfudGAfAfuagauucucaL96 | 2352 | VPusdGsagadA(Tgn)cuaudTcAfudGcacuasgsu | 2353 |
| APP | AD-886851.1 | usasgug(Chd)AfudGAfAfuagauucucaL96 | 2354 | VPusdGsagdAa(Tgn)cuaudTcAfudGcacuasgsu | 2355 |
| APP | AD-886852.1 | usasgug(Chd)AfudGAfAfuagauucucaL96 | 2356 | VPusdGsagadA(Tgn)cuaudTcAfugcacuasgsu | 2357 |
| APP | AD-886853.1 | usasgug(Chd)AfudGAfAfuagauucucaL96 | 2358 | VPusdGsagdAa(Tgn)cuaudTcAfugcacuasgsu | 2359 |
| APP | AD-886854.1 | usasgug(Chd)AfudGadAuagauucucaL96 | 2360 | VPusdGsagdAa(Tgn)cuaudTcAfugcacuasgsu | 2361 |
| APP | AD-886855.1 | usasgug(Chd)AfudGAfAfuagauucucaL96 | 2362 | VPudGagadA(Tgn)cuauucAfudGcacuasgsu | 2363 |
| APP | AD-886856.1 | usasgug(Chd)AfudGAfAfuagauucucaL96 | 2364 | VPudGagdAa(Tgn)cuauucAfudGcacuasgsu | 2365 |
| APP | AD-886857.1 | usasgug(Chd)AfudGAfAfuagauucucaL96 | 2366 | VPudGagadA(Tgn)cuaudTcAfudGcacuasgsu | 2367 |
| APP | AD-886858.1 | usasgug(Chd)AfudGAfAfuagauucucaL96 | 2368 | VPudGagdAa(Tgn)cuaudTcAfudGcacuasgsu | 2369 |
| APP | AD-886859.1 | usasgug(Chd)AfudGAfAfuagauucucaL96 | 2370 | VPudGagadA(Tgn)cuaudTcAfugcacuasgsu | 2371 |
| APP | AD-886860.1 | usasgug(Chd)AfudGAfAfuagauucucaL96 | 2372 | VPudGagdAa(Tgn)cuaudTcAfugcacuasgsu | 2373 |
| APP | AD-886861.1 | usasgug(Chd)AfuGfAfAfuagauucucaL96 | 2374 | VPusGfsagaa(Tgn)cuauucAfuGfcacuasusg | 2375 |
| APP | AD-886862.1 | usasgug(Chd)AfudGAfAfuagauucucaL96 | 2376 | VPusdGsagadA(Tgn)cuaudTcAfudGcacuasusg | 2377 |

TABLE 14-continued

Additional Human APP Modified Sequences.

| Target | Duplex Name | Sense Sequence (5' to 3') | SEQ ID NO | Antisense Sequence (5' to 3') | SEQ ID NO |
|---|---|---|---|---|---|
| APP | AD-886863.1 | usasgug(Chd)AfudGAfAfuagauucucaL96 | 2378 | VPusdGsagdAa(Tgn)cuaudTcAfudGcacuasusg | 2379 |
| APP | AD-886864.1 | gsgscua(Chd)GfaAfAfAfuccaaccuaaT96 | 2380 | VPusUfsaggu(Tgn)ggauuuUfcGfuagccsgsu | 2381 |
| APP | AD-886865.1 | gsgscua(Chd)gaAfAfAfuccaaccuaaL96 | 2382 | VPusUfsaggu(Tgn)ggauuuUfcGfuagccsgsu | 2383 |
| APP | AD-886866.1 | gsgscua(Chd)dGaAfAfAfuccaaccuaaL96 | 2384 | VPusUfsaggu(Tgn)ggauuuUfcGfuagccsgsu | 2385 |
| APP | AD-886867.1 | gsgscua(Chd)GfaAfAfAfuccaaccuaaT96 | 2386 | VPusUfaggu(Tgn)ggauuuUfcGfuagccsgsu | 2387 |
| APP | AD-886868.1 | gsgscua(Chd)GfaAfAfAfuccaaccuaaT96 | 2388 | VPusUfsaggu(Tgn)ggauuuUfcguagccsgsu | 2389 |
| APP | AD-886869.1 | gsgscua(Chd)GfaAfAfAfuccaaccuaaT96 | 2390 | VPusUfsaggu(Tgn)ggauuutlfcdGuagccsgsu | 2391 |
| APP | AD-886870.1 | gsgscua(Chd)GfaAfAfAfuccaaccuaaT96 | 2392 | VPusUfsaggu(Tgn)ggaudTuUfcdGuagccsgsu | 2393 |
| APP | AD-886871.1 | gsgscua(Chd)gaAfaAfuccaaccuaaL96 | 2394 | VPusUfsaggu(Tgn)ggaudTuUfcdGuagccsgsu | 2395 |
| APP | AD-886872.1 | gsgscua(Chd)gaAfaAfuccaaccuaaL96 | 2396 | VPusUfsaggu(Tgn)ggauUfuUfcdGuagccsgsu | 2397 |
| APP | AD-886873.1 | gsgscua(Chd)gadAadAuccaaccuaaL96 | 2398 | VPusUfsaggu(Tgn)ggaudTuUfcdGuagccsgsu | 2399 |
| APP | AD-886874.1 | gsgscua(Chd)GfaAfAfAfuccaaccuaaT96 | 2400 | VPusUfsaggu(Tgn)ggaudTuUfcguagccsgsu | 2401 |
| APP | AD-886875.1 | gsgscua(Chd)gaAfaAfuccaaccuaaL96 | 2402 | VPusUfsaggu(Tgn)ggaudTuUfcguagccsgsu | 2403 |
| APP | AD-886876.1 | gsgscua(Chd)gaAfaAfuccaaccuaaL96 | 2404 | VPusUfsaggu(Tgn)ggauUfuUfcguagccsgsu | 2405 |
| APP | AD-886877.1 | gsgscua(Chd)gadAadAuccaaccuaaL96 | 2406 | VPusUfsaggu(Tgn)ggaudTuUfcguagccsgsu | 2407 |
| APP | AD-886878.1 | gsgscua(Chd)gaAfAfAfuccaaccuaaL96 | 2408 | VPusUfsaggu(Tgn)ggauuuUfcguagccsgsu | 2409 |
| APP | AD-886879.1 | gsgscua(Chd)gaAfAfAfuccaaccuaaL96 | 2410 | VPusUfsaggu(Tgn)ggauuutlfcdGuagccsgsu | 2411 |
| APP | AD-886880.1 | gsgscua(Chd)gaAfAfAfuccaaccuaaL96 | 2412 | VPusUfsaggu(Tgn)ggaudTuUfcdGuagccsgsu | 2413 |
| APP | AD-886881.1 | gsgscua(Chd)gaAfAfAfuccaaccuaaL96 | 2414 | VPusUfsaggu(Tgn)ggaudTuUfcguagccsgsu | 2415 |
| APP | AD-886882.1 | gsgscua(Chd)gaAfAfAfuccaaccuaaL96 | 2416 | VPuUfaggdT(Tgn)ggauuuUfcguagccsgsu | 2417 |
| APP | AD-886883.1 | gsgscua(Chd)gaAfAfAfuccaaccuaaL96 | 2418 | VPuUfaggdT(Tgn)ggauuuUTcdGuagccsgsu | 2419 |
| APP | AD-886884.1 | gsgscua(Chd)gaAfAfAfuccaaccuaaL96 | 2420 | VPuUfaggdT(Tgn)ggaudTuUfcdGuagccsgsu | 2421 |
| APP | AD-886885.1 | gsgscua(Chd)gaAfAfAfuccaaccuaaL96 | 2422 | VPuUfaggdT(Tgn)ggaudTuUfcguagccsgsu | 2423 |
| APP | AD-886886.1 | gsgscua(Chd)gaAfAfAfuccaaccuaaL96 | 2424 | VPuUfagdGu(Tgn)ggauuufacguagccsgsu | 2425 |
| APP | AD-886887.1 | gsgscua(Chd)gaAfAfAfuccaaccuaaL96 | 2426 | VPuUfagdGu(Tgn)ggauuufacdGuagccsgsu | 2427 |

TABLE 14-continued

Additional Human APP Modified Sequences.

| Target | Duplex Name | Sense Sequence (5' to 3') | SEQ ID NO | Antisense Sequence (5' to 3') | SEQ ID NO |
|---|---|---|---|---|---|
| APP | AD-886888.1 | gsgscua(Chd)gaAfAfAfuccaaccuaaL96 | 2428 | VPuUfagdGu(Tgn)ggaudTuUfcdGuagccsgsu | 2429 |
| APP | AD-886889.1 | gsgscua(Chd)gaAfAfAfuccaaccuaaL96 | 2430 | VPuUfagdGu(Tgn)ggaudTuUfcguagccsgsu | 2431 |
| APP | AD-886890.1 | gsgscua(Chd)GfaAfAfAfuccaaccuaaT96 | 2432 | VPusUfsaggu(Tgn)ggauuufacGfuagccsusg | 2433 |
| APP | AD-886891.1 | gsgscua(Chd)gaAfAfAfuccaaccuaaL96 | 2434 | VPusUfsaggu(Tgn)ggauuufacdGuagccsusg | 2435 |
| APP | AD-886892.1 | gsgscua(Chd)gaAfAfAfuccaaccuaaL96 | 2436 | VPuUfaggdT(Tgn)ggaudTuUfcdGuagccsgsu | 2437 |
| APP | AD-886893.1 | gsgscua(Chd)gaAfAfAfuccaaccuaaL96 | 2438 | VPuUfagdGu(Tgn)ggaudTuUfcdGuagccsgsu | 2439 |
| APP | AD-886894.1 | asasaga(Ghd)CfaAfAfAfcuauucagaaL96 | 2440 | VPusUfscugAfaUfAfguuuUfgCfucuuuscsu | 2441 |
| APP | AD-886895.1 | asasag(Ahd)gCfaAfAfAfcuauucagaaT96 | 2442 | VPusUfscugAfaUfAfguuuUfgCfucuuuscsu | 2443 |
| APP | AD-886896.1 | asasagag(Chd)aAfAfAfcuauucagaaL96 | 2444 | VPusUfscugAfaUfAfguuuUfgCfucuuuscsu | 2445 |
| APP | AD-886897.1 | asasagagCfaAfAfAfcua(Uhd)ucagaaL96 | 2446 | VPusUfscugAfaUfAfguuuUfgCfucuuuscsu | 2447 |
| APP | AD-886898.1 | asasagagCfaAfAfAfcuau(Uhd)cagaaT96 | 2448 | VPusUfscugAfaUfAfguuuUfgCfucuuuscsu | 2449 |
| APP | AD-886899.1 | asasagagCfaAfAfAfcuauu(Chd)agaaL96 | 2450 | VPusUfscugAfaUfAfguuuUfgCfucuuuscsu | 2451 |
| APP | AD-886900.1 | asasaga(Ghd)CfaAfAfAfcuauucagaaL96 | 2452 | VPusUfscugAfauaguuuUfgCfucuuuscsu | 2453 |
| APP | AD-886901.1 | asasaga(Ghd)CfaAfAfAfcuauucagaaL96 | 2454 | VPuUfcugAfaUfAfguuuUfgCfucuuuscsu | 2455 |
| APP | AD-886902.1 | asasaga(Ghd)CfaAfAfAfcuauucagaaL96 | 2456 | VPuUfcugAfauaguuuUfgCfucuuuscsu | 2457 |
| APP | AD-886903.1 | asasag(Ahd)gCfaAfAfAfcuauucagaaT96 | 2458 | VPuUfcugAfaUfAfguuuUfgCfucuuuscsu | 2459 |
| APP | AD-886904.1 | asasag(Ahd)gCfaAfAfAfcuauucagaaT96 | 2460 | VPuUfcugAfauaguuuUfgCfucuuuscsu | 2461 |
| APP | AD-886905.1 | asasagag(Chd)aAfAfAfcuauucagaaL96 | 2462 | VPuUfcugAfaUfAfguuuUfgCfucuuuscsu | 2463 |
| APP | AD-886906.1 | asasagag(Chd)aAfAfAfcuauucagaaL96 | 2464 | VPuUfcugAfauaguuuUfgCfucuuuscsu | 2465 |
| APP | AD-886907.1 | asasagag(Chd)aAfaAfcuauucagaaL96 | 2466 | VPuUfcugAfauagudTuUfgCfucuuuscsu | 2467 |
| APP | AD-886908.1 | asasagag(Chd)adAadAcuauucagaaL96 | 2468 | VPuUfcugAfauagudTuUfgCfucuuuscsu | 2469 |
| APP | AD-886909.1 | asasagag(Chd)adAadAcuauucagaaL96 | 2470 | VPuUfcugdAauagudTuUfgdCucuuuscsu | 2471 |
| APP | AD-886910.1 | asasaga(Ghd)CfaAfAfAfcuauucagaaL96 | 2472 | VPusUfscugAfauaguuuUfgCfucuuususg | 2473 |
| APP | AD-886911.1 | asasagagCfaAfAfAfcua(Uhd)ucagaaL96 | 2474 | VPuUfcugAfauaguuuUfgCfucuuususg | 2475 |
| APP | AD-886912.1 | asasagag(Chd)aAfAfAfcuauucagaaL96 | 2476 | VPuUfcugAfauaguuuUfgCfucuuususg | 2477 |

TABLE 14-continued

Additional Human APP Modified Sequences.

| Target | Duplex Name | Sense Sequence (5' to 3') | SEQ ID NO | Antisense Sequence (5' to 3') | SEQ ID NO |
|---|---|---|---|---|---|
| APP | AD-886913.1 | ususuau(Ghd)AfuUfUfAfcucauuaucaL96 | 2478 | VPusGfsauaAfuGfAfguaaAfuCfauaaasasc | 2479 |
| APP | AD-886914.1 | ususua(Uhd)gAfuUfUfAfcucauuaucaL96 | 2480 | VPusGfsauaAfuGfAfguaaAfuCfauaaasasc | 2481 |
| APP | AD-886915.1 | ususuaug(Ahd)uUfUfAfcucauuaucaL96 | 2482 | VPusGfsauaAfuGfAfguaaAfuCfauaaasasc | 2483 |
| APP | AD-886916.1 | ususuaugAfuUTUfAfcuc(Ahd)uuaucaL96 | 2484 | VPusGfsauaAfuGfAfguaaAfuCfauaaasasc | 2485 |
| APP | AD-886917.1 | ususuaugAfuUfUfAfcuca(Uhd)uaucaL96 | 2486 | VPusGfsauaAfuGfAfguaaAfuCfauaaasasc | 2487 |
| APP | AD-886918.1 | ususuaugAfuUfUfAfcucau(Uhd)aucaL96 | 2488 | VPusGfsauaAfuGfAfguaaAfuCfauaaasasc | 2489 |
| APP | AD-886919.1 | ususuau(Ghd)AfuUfUfAfcucauuaucaL96 | 2490 | VPusGfsauaAfugaguaaAfuCfauaaasasc | 2491 |
| APP | AD-886920.1 | ususuau(Ghd)AfuUfUfAfcucauuaucaL96 | 2492 | VPusdGsauaAfugaguaaAfuCfauaaasasc | 2493 |
| APP | AD-886921.1 | ususuau(Ghd)AfuUfUfAfcucauuaucaL96 | 2494 | VPudGauaAfugaguaaAfuCfauaaasasc | 2495 |
| APP | AD-886922.1 | ususua(Uhd)gAfuUfUfAfcucauuaucaL96 | 2496 | VPusdGsauaAfugaguaaAfuCfauaaasasc | 2497 |
| APP | AD-886923.1 | ususua(Uhd)gAfuUfUfAfcucauuaucaL96 | 2498 | VPudGauaAfugaguaaAfuCfauaaasasc | 2499 |
| APP | AD-886924.1 | ususuaug(Ahd)uUfUfAfcucauuaucaL96 | 2500 | VPusdGsauaAfugaguaaAfuCfauaaasasc | 2501 |
| APP | AD-886925.1 | ususuaug(Ahd)uUfUfAfcucauuaucaL96 | 2502 | VPudGauaAfugaguaaAfuCfauaaasasc | 2503 |
| APP | AD-886926.1 | ususuaug(Ahd)uUfuAfcucauuaucaL96 | 2504 | VPudGauadAugagudAaAfuCfauaaasasc | 2505 |
| APP | AD-886927.1 | ususuaug(Ahd)uUfudAcucauuaucaL96 | 2506 | VPudGauadAugagudAaAfuCfauaaasasc | 2507 |
| APP | AD-886928.1 | ususuaug(Ahd)uUfudAcucauuaucaL96 | 2508 | VPudGauadAugagudAaAfudCauaaasasc | 2509 |
| APP | AD-886929.1 | ususuau(Ghd)AfuUfUfAfcucauuaucaL96 | 2510 | VPusGfsauaAfugaguaaAfuCfauaaasusg | 2511 |
| APP | AD-886930.1 | ususuaugAfuUTUfAfcuc(Ahd)uuaucaL96 | 2512 | VPusdGsauaAfugaguaaAfuCfauaaasusg | 2513 |
| APP | AD-886931.1 | ususuaug(Ahd)uUfUfAfcucauuaucaL96 | 2514 | VPusdGsauaAfugaguaaAfuCfauaaasusg | 2515 |

Table 14 key: U = uridine-3'-phosphate, u = 2'-O-methyluridine-3'-phosphate, us = 2'-O-methyluridine-3'-phosphorothioate, a = 2'-O-methyladenosine-3'-phosphate, A = adenosine-3'-phosphate, as = 2'-O-methyladenosine-3'-phosphorothioate, (Ahd) = 2'-O-hexadecyl-adenosine-3'-phosphate, Gf = 2'-fluoroguanosine-3'-phosphate, Uf = fluorouridine-3'-phosphate, Cf = 2'-fluorocytidine-3'-phosphate, Af = 2'-fluoroadenosine-3'-phosphate, cs = 2'-O-methylcytidine-3'-phosphate, VP = Vinylphosphate 5', (Agn) = Adenosine-glycol nucleic acid (GNA), gs = 2'-O-methylguanosine-3'-phosphorothioate, (Chd) = 2'-O-hexadecyl-cytidine-3'-phosphate, (Tgn) = Thymidine-glycol nucleic acid (GNA) S-Isomer, (Ghd) = 2'-O-hexadecyl-guanosine-3'-phosphate, and cs = 2'-O-methylcytidine-3'-phosphorothioate.

TABLE 15

Additional APP Unmodified Sequences.

| Duplex Name | Sense Sequence (5' to 3') | SEQ ID NO | Antisense Sequence (5' to 3') | SEQ ID NO |
|---|---|---|---|---|
| AD-886823.1 | UAGUGCAUGAAUAGAUUCUCA | 2516 | UGAGAAUCUAUUCAUGCACUAGU | 2517 |
| AD-886824.1 | UAGUGCAUGAAUAGAUUCUCA | 2518 | UGAGAAUCUAUUCAUGCACUAGU | 2519 |
| AD-886825.1 | UAGUGCAUGAAUAGAUUCUCA | 2520 | UGAGAAUCUAUUCAUGCACUAGU | 2521 |
| AD-886826.1 | UAGUGCAUGAAUAGAUUCUCA | 2522 | UGAGAAUCUAUUCAUGCACUAGU | 2523 |
| AD-886827.1 | UAGUGCAUGAAUAGAUUCUCA | 2524 | UGAGAAUCUAUUCAUGCACUAGU | 2525 |
| AD-886828.1 | UAGUGCAUGAAUAGAUUCUCA | 2526 | UGAGAAUCUAUUCAUGCACUAGU | 2527 |
| AD-886829.1 | UAGUGCAUGAAUAGAUUCUCA | 2528 | UGAGAAUCUAUUCAUGCACUAGU | 2529 |
| AD-886830.1 | UAGUGCAUGAAUAGAUUCUCA | 2530 | UGAGAAUCUAUUCAUGCACUAGU | 2531 |
| AD-886831.1 | UAGUGCAUGAAUAGAUUCUCA | 2532 | UGAGAAUCUAUUCAUGCACUAGU | 2533 |
| AD-886832.1 | UAGUGCAUGAAUAGAUUCUCA | 2534 | UGAGAAUCUAUUCAUGCACUAGU | 2535 |
| AD-886833.1 | UAGUGCAUGAAUAGAUUCUCA | 2536 | UGAGAAUCUAUUCAUGCACUAGU | 2537 |
| AD-886834.1 | UAGUGCAUGAAUAGAUUCUCA | 2538 | UGAGAAUCUAUUCAUGCACUAGU | 2539 |
| AD-886836.1 | UAGUGCAUGAAUAGAUUCUCA | 2540 | UGAGAAUCUAUUCAUGCACUAGU | 2541 |
| AD-886837.1 | UAGUGCAUGAAUAGAUUCUCA | 2542 | UGAGAAUCUAUUCAUGCACUAGU | 2543 |
| AD-886838.1 | UAGUGCAUGAAUAGAUUCUCA | 2544 | UGAGAAUCUAUUCAUGCACUAGU | 2545 |
| AD-886839.1 | UAGUGCAUGAAUAGAUUCUCA | 2546 | UGAGAAUCUAUUCAUGCACUAGU | 2547 |
| AD-886839.2 | UAGUGCAUGAAUAGAUUCUCA | 2548 | UGAGAAUCUAUUCAUGCACUAGU | 2549 |
| AD-886840.1 | UAGUGCAUGAAUAGAUUCUCA | 2550 | UGAGAAUCUAUUCAUGCACUAGU | 2551 |
| AD-886841.1 | UAGUGCAUGAAUAGAUUCUCA | 2552 | UGAGAAUCUAUUCAUGCACUAGU | 2553 |
| AD-886842.1 | UAGUGCAUGAAUAGAUUCUCA | 2554 | UGAGAAUCUAUUCAUGCACUAGU | 2555 |
| AD-886843.1 | UAGUGCAUGAAUAGAUUCUCA | 2556 | UGAGAAUCUAUUCAUGCACUAGU | 2557 |
| AD-886844.1 | UAGUGCAUGAAUAGAUUCUCA | 2558 | UGAGAAUCUAUUCAUGCACUAGU | 2559 |
| AD-886845.1 | UAGUGCAUGAAUAGAUUCUCA | 2560 | UGAGAAUCUAUUCAUGCACUAGU | 2561 |
| AD-886846.1 | UAGUGCAUGAAUAGAUUCUCA | 2562 | UGAGAAUCUAUUCAUGCACUAGU | 2563 |
| AD-886847.1 | UAGUGCAUGAAUAGAUUCUCA | 2564 | UGAGAAUCUAUUCAUGCACUAGU | 2565 |

TABLE 15 -continued

Additional APP Unmodified Sequences.

| Duplex Name | Sense Sequence (5' to 3') | SEQ ID NO | Antisense Sequence (5' to 3') | SEQ ID NO |
|---|---|---|---|---|
| AD-886848.1 | UAGUGCAUGAAUAGAUUCUCA | 2566 | UGAGAAUCUAUUCAUGCACUAGU | 2567 |
| AD-886849.1 | UAGUGCAUGAAUAGAUUCUCA | 2568 | UGAGAAUCUAUUCAUGCACUAGU | 2569 |
| AD-886850.1 | UAGUGCAUGAAUAGAUUCUCA | 2570 | UGAGAAUCUAUTCAUGCACUAGU | 2571 |
| AD-886851.1 | UAGUGCAUGAAUAGAUUCUCA | 2572 | UGAGAAUCUAUTCAUGCACUAGU | 2573 |
| AD-886852.1 | UAGUGCAUGAAUAGAUUCUCA | 2574 | UGAGAAUCUAUTCAUGCACUAGU | 2575 |
| AD-886853.1 | UAGUGCAUGAAUAGAUUCUCA | 2576 | UGAGAAUCUAUTCAUGCACUAGU | 2577 |
| AD-886854.1 | UAGUGCAUGAAUAGAUUCUCA | 2578 | UGAGAAUCUAUTCAUGCACUAGU | 2579 |
| AD-886855.1 | UAGUGCAUGAAUAGAUUCUCA | 2580 | UGAGAAUCUAUUCAUGCACUAGU | 2581 |
| AD-886856.1 | UAGUGCAUGAAUAGAUUCUCA | 2582 | UGAGAAUCUAUUCAUGCACUAGU | 2583 |
| AD-886857.1 | UAGUGCAUGAAUAGAUUCUCA | 2584 | UGAGAAUCUAUTCAUGCACUAGU | 2585 |
| AD-886858.1 | UAGUGCAUGAAUAGAUUCUCA | 2586 | UGAGAAUCUAUTCAUGCACUAGU | 2587 |
| AD-886859.1 | UAGUGCAUGAAUAGAUUCUCA | 2588 | UGAGAAUCUAUTCAUGCACUAGU | 2589 |
| AD-886860.1 | UAGUGCAUGAAUAGAUUCUCA | 2590 | UGAGAAUCUAUTCAUGCACUAGU | 2591 |
| AD-886861.1 | UAGUGCAUGAAUAGAUUCUCA | 2592 | UGAGAAUCUAUUCAUGCACUAUG | 2593 |
| AD-886862.1 | UAGUGCAUGAAUAGAUUCUCA | 2594 | UGAGAAUCUAUTCAUGCACUAUG | 2595 |
| AD-886863.1 | UAGUGCAUGAAUAGAUUCUCA | 2596 | UGAGAAUCUAUTCAUGCACUAUG | 2597 |
| AD-886864.1 | GGCUACGAAAAUCCAACCUAA | 2598 | UUAGGUTGGAUUUUCGUAGCCGU | 2599 |
| AD-886865.1 | GGCUACGAAAAUCCAACCUAA | 2600 | UUAGGUTGGAUUUUCGUAGCCGU | 2601 |
| AD-886866.1 | GGCUACGAAAAUCCAACCUAA | 2602 | UUAGGUTGGAUUUUCGUAGCCGU | 2603 |
| AD-886867.1 | GGCUACGAAAAUCCAACCUAA | 2604 | UUAGGUTGGAUUUUCGUAGCCGU | 2605 |
| AD-886868.1 | GGCUACGAAAAUCCAACCUAA | 2606 | UUAGGUTGGAUUUUCGUAGCCGU | 2607 |
| AD-886869.1 | GGCUACGAAAAUCCAACCUAA | 2608 | UUAGGUTGGAUUUUCGUAGCCGU | 2609 |
| AD-886870.1 | GGCUACGAAAAUCCAACCUAA | 2610 | UUAGGUTGGAUTUUCGUAGCCGU | 2611 |
| AD-886871.1 | GGCUACGAAAAUCCAACCUAA | 2612 | UUAGGUTGGAUTUUCGUAGCCGU | 2613 |
| AD-886872.1 | GGCUACGAAAAUCCAACCUAA | 2614 | UUAGGUTGGAUUUUCGUAGCCGU | 2615 |

TABLE 15 -continued

Additional APP Unmodified Sequences.

| Duplex Name | Sense Sequence (5' to 3') | SEQ ID NO | Antisense Sequence (5' to 3') | SEQ ID NO |
|---|---|---|---|---|
| AD-886873.1 | GGCUACGAAAAUCCAACCUAA | 2616 | UUAGGUTGGAUTUUCGUAGCCGU | 2617 |
| AD-886874.1 | GGCUACGAAAAUCCAACCUAA | 2618 | UUAGGUTGGAUTUUCGUAGCCGU | 2619 |
| AD-886875.1 | GGCUACGAAAAUCCAACCUAA | 2620 | UUAGGUTGGAUTUUCGUAGCCGU | 2621 |
| AD-886876.1 | GGCUACGAAAAUCCAACCUAA | 2622 | UUAGGUTGGAUUUUCGUAGCCGU | 2623 |
| AD-886877.1 | GGCUACGAAAAUCCAACCUAA | 2624 | UUAGGUTGGAUTUUCGUAGCCGU | 2625 |
| AD-886878.1 | GGCUACGAAAAUCCAACCUAA | 2626 | UUAGGUTGGAUUUUCGUAGCCGU | 2627 |
| AD-886879.1 | GGCUACGAAAAUCCAACCUAA | 2628 | UUAGGUTGGAUUUUCGUAGCCGU | 2629 |
| AD-886880.1 | GGCUACGAAAAUCCAACCUAA | 2630 | UUAGGUTGGAUTUUCGUAGCCGU | 2631 |
| AD-886881.1 | GGCUACGAAAAUCCAACCUAA | 2632 | UUAGGUTGGAUTUUCGUAGCCGU | 2633 |
| AD-886882.1 | GGCUACGAAAAUCCAACCUAA | 2634 | UUAGGUTGGAUUUUCGUAGCCGU | 2635 |
| AD-886883.1 | GGCUACGAAAAUCCAACCUAA | 2636 | UUAGGUTGGAUUUUCGUAGCCGU | 2637 |
| AD-886884.1 | GGCUACGAAAAUCCAACCUAA | 2638 | UUAGGUTGGAUTUUCGUAGCCGU | 2639 |
| AD-886885.1 | GGCUACGAAAAUCCAACCUAA | 2640 | UUAGGUTGGAUTUUCGUAGCCGU | 2641 |
| AD-886886.1 | GGCUACGAAAAUCCAACCUAA | 2642 | UUAGGUTGGAUUUUCGUAGCCGU | 2643 |
| AD-886887.1 | GGCUACGAAAAUCCAACCUAA | 2644 | UUAGGUTGGAUUUUCGUAGCCGU | 2645 |
| AD-886888.1 | GGCUACGAAAAUCCAACCUAA | 2646 | UUAGGUTGGAUTUUCGUAGCCGU | 2647 |
| AD-886889.1 | GGCUACGAAAAUCCAACCUAA | 2648 | UUAGGUTGGAUTUUCGUAGCCGU | 2649 |
| AD-886890.1 | GGCUACGAAAAUCCAACCUAA | 2650 | UUAGGUTGGAUUUUCGUAGCCUG | 2651 |
| AD-886891.1 | GGCUACGAAAAUCCAACCUAA | 2652 | UUAGGUTGGAUUUUCGUAGCCUG | 2653 |
| AD-886892.1 | GGCUACGAAAAUCCAACCUAA | 2654 | UUAGGUTGGAUTUUCGUAGCCUG | 2655 |
| AD-886893.1 | GGCUACGAAAAUCCAACCUAA | 2656 | UUAGGUTGGAUTUUCGUAGCCUG | 2657 |
| AD-886894.1 | AAAGAGCAAAACUAUUCAGAA | 2658 | UUCUGAAUAGUUUUGCUCUUUCU | 2659 |
| AD-886895.1 | AAAGAGCAAAACUAUUCAGAA | 2660 | UUCUGAAUAGUUUUGCUCUUUCU | 2661 |
| AD-886896.1 | AAAGAGCAAAACUAUUCAGAA | 2662 | UUCUGAAUAGUUUUGCUCUUUCU | 2663 |
| AD-886897.1 | AAAGAGCAAAACUAUUCAGAA | 2664 | UUCUGAAUAGUUUUGCUCUUUCU | 2665 |

TABLE 15 -continued

Additional APP Unmodified Sequences.

| Duplex Name | Sense Sequence (5' to 3') | SEQ ID NO | Antisense Sequence (5' to 3') | SEQ ID NO |
|---|---|---|---|---|
| AD-886898.1 | AAAGAGCAAAACUAUUCAGAA | 2666 | UUCUGAAUAGUUUUGCUCUUUCU | 2667 |
| AD-886899.1 | AAAGAGCAAAACUAUUCAGAA | 2668 | UUCUGAAUAGUUUUGCUCUUUCU | 2669 |
| AD-886900.1 | AAAGAGCAAAACUAUUCAGAA | 2670 | UUCUGAAUAGUUUUGCUCUUUCU | 2671 |
| AD-886901.1 | AAAGAGCAAAACUAUUCAGAA | 2672 | UUCUGAAUAGUUUUGCUCUUUCU | 2673 |
| AD-886902.1 | AAAGAGCAAAACUAUUCAGAA | 2674 | UUCUGAAUAGUUUUGCUCUUUCU | 2675 |
| AD-886903.1 | AAAGAGCAAAACUAUUCAGAA | 2676 | UUCUGAAUAGUUUUGCUCUUUCU | 2677 |
| AD-886904.1 | AAAGAGCAAAACUAUUCAGAA | 2678 | UUCUGAAUAGUUUUGCUCUUUCU | 2679 |
| AD-886905.1 | AAAGAGCAAAACUAUUCAGAA | 2680 | UUCUGAAUAGUUUUGCUCUUUCU | 2681 |
| AD-886906.1 | AAAGAGCAAAACUAUUCAGAA | 2682 | UUCUGAAUAGUUUUGCUCUUUCU | 2683 |
| AD-886907.1 | AAAGAGCAAAACUAUUCAGAA | 2684 | UUCUGAAUAGUTUUGCUCUUUCU | 2685 |
| AD-886908.1 | AAAGAGCAAAACUAUUCAGAA | 2686 | UUCUGAAUAGUTUUGCUCUUUCU | 2687 |
| AD-886909.1 | AAAGAGCAAAACUAUUCAGAA | 2688 | UUCUGAAUAGUTUUGCUCUUUCU | 2689 |
| AD-886910.1 | AAAGAGCAAAACUAUUCAGAA | 2690 | UUCUGAAUAGUUUUGCUCUUUUG | 2691 |
| AD-886911.1 | AAAGAGCAAAACUAUUCAGAA | 2692 | UUCUGAAUAGUUUUGCUCUUUUG | 2693 |
| AD-886912.1 | AAAGAGCAAAACUAUUCAGAA | 2694 | UUCUGAAUAGUUUUGCUCUUUUG | 2695 |
| AD-886913.1 | UUUAUGAUUUACUCAUUAUCA | 2696 | UGAUAAUGAGUAAAUCAUAAAC | 2697 |
| AD-886914.1 | UUUAUGAUUUACUCAUUAUCA | 2698 | UGAUAAUGAGUAAAUCAUAAAC | 2699 |
| AD-886915.1 | UUUAUGAUUUACUCAUUAUCA | 2700 | UGAUAAUGAGUAAAUCAUAAAC | 2701 |
| AD-886916.1 | UUUAUGAUUUACUCAUUAUCA | 2702 | UGAUAAUGAGUAAAUCAUAAAC | 2703 |
| AD-886917.1 | UUUAUGAUUUACUCAUUAUCA | 2704 | UGAUAAUGAGUAAAUCAUAAAC | 2705 |
| AD-886918.1 | UUUAUGAUUUACUCAUUAUCA | 2706 | UGAUAAUGAGUAAAUCAUAAAC | 2707 |
| AD-886919.1 | UUUAUGAUUUACUCAUUAUCA | 2708 | UGAUAAUGAGUAAAUCAUAAAC | 2709 |
| AD-886920.1 | UUUAUGAUUUACUCAUUAUCA | 2710 | UGAUAAUGAGUAAAUCAUAAAC | 2711 |
| AD-886921.1 | UUUAUGAUUUACUCAUUAUCA | 2712 | UGAUAAUGAGUAAAUCAUAAAC | 2713 |
| AD-886922.1 | UUUAUGAUUUACUCAUUAUCA | 2714 | UGAUAAUGAGUAAAUCAUAAAC | 2715 |

TABLE 15 -continued

Additional APP Unmodified Sequences.

| Duplex Name | Sense Sequence (5' to 3') | SEQ ID NO | Antisense Sequence (5' to 3') | SEQ ID NO |
|---|---|---|---|---|
| AD-886923.1 | UUUAUGAUUUACUCAUUAUCA | 2716 | UGAUAAUGAGUAAAUCAUAAAAC | 2717 |
| AD-886924.1 | UUUAUGAUUUACUCAUUAUCA | 2718 | UGAUAAUGAGUAAAUCAUAAAAC | 2719 |
| AD-886925.1 | UUUAUGAUUUACUCAUUAUCA | 2720 | UGAUAAUGAGUAAAUCAUAAAAC | 2721 |
| AD-886926.1 | UUUAUGAUUUACUCAUUAUCA | 2722 | UGAUAAUGAGUAAAUCAUAAAAC | 2723 |
| AD-886927.1 | UUUAUGAUUUACUCAUUAUCA | 2724 | UGAUAAUGAGUAAAUCAUAAAAC | 2725 |
| AD-886928.1 | UUUAUGAUUUACUCAUUAUCA | 2726 | UGAUAAUGAGUAAAUCAUAAAAC | 2727 |
| AD-886929.1 | UUUAUGAUUUACUCAUUAUCA | 2728 | UGAUAAUGAGUAAAUCAUAAAUG | 2729 |
| AD-886930.1 | UUUAUGAUUUACUCAUUAUCA | 2730 | UGAUAAUGAGUAAAUCAUAAAUG | 2731 |
| AD-886931.1 | UUUAUGAUUUACUCAUUAUCA | 2732 | UGAUAAUGAGUAAAUCAUAAAUG | 2733 |

TABLE 16A

Additional Human APP Modified and Unmodified Sense Sequences.

| Duplex Name | target | Modified Sense Sequence (5' to 3') | SEQ ID NO | Unmodified Sense Sequence (5' to 3') | SEQ ID NO |
|---|---|---|---|---|---|
| AD-961583 | APP | gsgscua(Chd)gadAadAuccaaccusasa | 2734 | GGCUACGAAAAUCCAACCUAA | 2735 |
| AD-961584 | APP | asasagag(Chd)aAfaAfcuauucagsasa | 2736 | AAAGAGCAAAACUAUUCAGAA | 2737 |
| AD-961585 | APP | asasagag(Chd)adAadAcuauucagsasa | 2738 | AAAGAGCAAAACUAUUCAGAA | 2739 |
| AD-961586 | APP | ususuau(Ghd)A-fuUafUfAfcucuuauscsa | 2740 | UUUAUGAUUUACUCAUUAUCA | 2741 |

Table 16A key:
U = uridine-3'-phosphate,
u = 2'-O-methyluridine-3'-phosphate,
us = 2'-O-methyluridine-3'-phosphorothioate,
a = 2'-O-methyladenosine-3'-phosphate,
A = adenosine-3'-phosphate,
as = 2'-O-methyladenosine-3'-phosphorothioate,
(Ahd) = 2'-O-hexadecyl-adenosine-3'-phosphate,
Gf = 2'-fluoroguanosine-3'-phosphate,
Uf = 2'-fluorouridine-3'-phosphate,
Cf = 2'-fluorocytidine-3'-phosphate,
Af = 2'-fluoroadenosine-3'-phosphate,
cs = 2'-O-methylcytidine-3'-phosphate ,
VP = Vinylphosphate 5',
(Agn) = Adenosine-glycol nucleic acid (GNA),
gs = 2'-O-methylguanosine-3'-phosphorothioate,
(Chd) = 2'-O-hexadecyl-cytidine-3'-phosphate,
(Tgn) = Thymidine-glycol nucleic acid (GNA) S-Isomer,
(Ghd) = 2'-O-hexadecyl-guanosine-3'-phosphate,
and
cs = 2'-O-methylcytidine-3'-phosphorothioate.

TABLE 16B

Additional Human APP Modified and Unmodified Antisense Sequences

| Duplex Name | target | Modified Antisense Sequence (5' to 3') | SEQ ID NO | Unmodified Antisense Sequence (5' to 3') | SEQ ID NO |
|---|---|---|---|---|---|
| AD-961583 | APP | VPusUfsaggu(Tgn)ggaudTuUfcdGuagccsgsu | 2742 | UUAGGUTGGAUTUUCGUAGCCGU | 2743 |
| AD-961584 | APP | VPuUfcugAfauagudTuUfgCfucuuuscsu | 2744 | UUCUGAAUAGUTUUGCUCUUUCU | 2745 |
| AD-961585 | APP | VPuUfcugdAauagudTuUfgdCucuuuscsu | 2746 | UUCUGAAUAGUTUUGCUCUUUCU | 2747 |
| AD-961586 | APP | VPusGfsauaAfugaguaaAfuCfauaaasusg | 2748 | UGAUAAUGAGUAAAUCAUAAAUG | 2749 |

Table 16B key:
U = uridine-3'-phosphate,
u = 2'-O-methyluridine-3'-phosphate,
us = 2'-O-methyluridine-3'-phosphorothioate,
a = 2'-O-methyladenosine-3'-phosphate,
A = adenosine-3'-phosphate,
as = 2'-O-methyladenosine-3'-phosphorothioate,
(Ahd) = 2'-O-hexadecyl-adenosine-3'-phosphate,
Gf = 2'-fluoroguanosine-3'-phosphate,
Uf = 2'-fluorouridine-3'-phosphate,
Cf = 2'-fluorocytidine-3'-phosphate,
Af = 2'-fluoroadenosine-3'-phosphate,
cs = 2'-O-methylcytidine-3'-phosphate,
VP = Vinylphosphate 5',
(Agn) = Adenosine-glycol nucleic acid (GNA),
gs = 2'-O-methylguanosine-3'-phosphorothioate,
(Chd) = 2'-O-hexadecyl-cytidine-3'-phosphate,
(Tgn) = Thymidine-glycol nucleic acid (GNA) S-Isomer,
(Ghd) = 2'-O-hexadecyl-guanosine-3'-phosphate,
and
cs = 2'-O-methylcytidine-3'-phosphorothioate.

Table 17 summarizes results from a multi-dose APP screen in Be(2) cells conducted at either 10 nM, 1 nM or 0.1 nM. Data are expressed as percent message remaining relative to AD-1955 non-targeting control.

TABLE 17

APP Dose Screen Study in Be(2)C Cell Lines at 10 nM, 1 nM, and 0.1 nM

| Duplex | Average message remaining (%) | Standard Deviation | Dose | Dose Unit |
|---|---|---|---|---|
| AD-738012.1 | 12.47 | 3.92 | 10 | nM |
| AD-738013.1 | 8.78 | 1.74 | 10 | nM |
| AD-738014.1 | 10.27 | 3.95 | 10 | nM |
| AD-738015.1 | 9.84 | 3.00 | 10 | nM |
| AD-738016.1 | 11.79 | 4.10 | 10 | nM |
| AD-738017.1 | 12.85 | 2.41 | 10 | nM |
| AD-738018.1 | 13.22 | 2.40 | 10 | nM |
| AD-738019.1 | 14.57 | 2.64 | 10 | nM |
| AD-738020.1 | 9.06 | 2.84 | 10 | nM |
| AD-738021.1 | 12.95 | 6.42 | 10 | nM |
| AD-738022.1 | 10.55 | 1.29 | 10 | nM |
| AD-738023.1 | 8.22 | 1.41 | 10 | nM |
| AD-738024.1 | 13.51 | 4.75 | 10 | nM |
| AD-738025.1 | 48.96 | 7.46 | 10 | nM |
| AD-738026.1 | 11.78 | 2.88 | 10 | nM |
| AD-738027.1 | 10.71 | 2.22 | 10 | nM |
| AD-738028.1 | 18.52 | 2.12 | 10 | nM |
| AD-738029.1 | 17.74 | 4.49 | 10 | nM |
| AD-738030.1 | 25.60 | 5.77 | 10 | nM |
| AD-738031.1 | 28.70 | 6.14 | 10 | nM |
| AD-738032.1 | 13.38 | 9.34 | 10 | nM |
| AD-738033.1 | 10.13 | 1.96 | 10 | nM |
| AD-738034.1 | 15.22 | 6.91 | 10 | nM |
| AD-738035.1 | 14.59 | 5.75 | 10 | nM |
| AD-738036.1 | 19.64 | 12.56 | 10 | nM |
| AD-738037.1 | 21.74 | 10.22 | 10 | nM |
| AD-738038.1 | 27.23 | 3.73 | 10 | nM |
| AD-738039.1 | 28.08 | 5.99 | 10 | nM |
| AD-738040.1 | 60.35 | 0.96 | 10 | nM |
| AD-738041.1 | 38.29 | 15.92 | 10 | nM |
| AD-738042.1 | 25.54 | 7.15 | 10 | nM |
| AD-738043.1 | 12.59 | 4.84 | 10 | nM |
| AD-738044.1 | 44.57 | 13.69 | 10 | nM |
| AD-738045.1 | 218.56 | 104.83 | 10 | nM |
| AD-738046.1 | 263.77 | 29.64 | 10 | nM |
| AD-738047.1 | 35.84 | 3.46 | 10 | nM |
| AD-738048.1 | 34.43 | 4.01 | 10 | nM |
| AD-397217.2 | 70.05 | 6.00 | 10 | nM |
| AD-738049.1 | 13.20 | 6.16 | 10 | nM |
| AD-738050.1 | 11.02 | 0.82 | 10 | nM |
| AD-738051.1 | 40.85 | 6.01 | 10 | nM |
| AD-738052.1 | 37.45 | 14.43 | 10 | nM |
| AD-738053.1 | 30.69 | 7.50 | 10 | nM |
| AD-738054.1 | 62.81 | 13.33 | 10 | nM |
| AD-738055.1 | 28.18 | 9.27 | 10 | nM |
| AD-738056.1 | 28.91 | 4.29 | 10 | nM |
| AD-738057.1 | 24.47 | 7.91 | 10 | nM |
| AD-738058.1 | 49.05 | 8.41 | 10 | nM |
| AD-738059.1 | 35.32 | 9.27 | 10 | nM |
| AD-738060.1 | 25.40 | 3.87 | 10 | nM |

TABLE 17-continued

APP Dose Screen Study in Be(2)C Cell Lines at 10 nM, 1 nM, and 0.1 nM

| Duplex | Average message remaining (%) | Standard Deviation | Dose | Dose Unit |
|---|---|---|---|---|
| AD-738061.1 | 53.19 | 2.95 | 10 | nM |
| AD-738062.1 | 17.28 | 7.65 | 10 | nM |
| AD-738063.1 | 33.40 | 9.94 | 10 | nM |
| AD-738064.1 | 30.75 | 4.43 | 10 | nM |
| AD-738065.1 | 28.34 | 14.64 | 10 | nM |
| AD-738066.1 | 92.51 | 16.17 | 10 | nM |
| AD-738067.1 | 30.74 | 7.71 | 10 | nM |
| AD-738068.1 | 25.12 | 2.84 | 10 | nM |
| AD-738069.1 | 59.72 | 9.34 | 10 | nM |
| AD-738070.1 | 35.03 | 9.43 | 10 | nM |
| AD-738071.1 | 15.79 | 2.79 | 10 | nM |
| AD-738072.1 | 63.54 | 33.06 | 10 | nM |
| AD-738073.1 | 28.05 | 3.62 | 10 | nM |
| AD-738074.1 | 31.74 | 5.88 | 10 | nM |
| AD-738075.1 | 174.04 | 56.95 | 10 | nM |
| AD-738076.1 | 29.35 | 8.89 | 10 | nM |
| AD-738077.1 | 14.69 | 5.00 | 10 | nM |
| AD-738078.1 | 15.15 | 2.61 | 10 | nM |
| AD-738079.1 | 11.40 | 3.42 | 10 | nM |
| AD-738080.1 | 10.80 | 0.91 | 10 | nM |
| AD-738081.1 | 36.37 | 8.31 | 10 | nM |
| AD-738082.1 | 28.65 | 4.80 | 10 | nM |
| AD-738083.1 | 9.98 | 0.75 | 10 | nM |
| AD-738084.1 | 31.76 | 4.26 | 10 | nM |
| AD-738085.1 | 48.74 | 6.11 | 10 | nM |
| AD-738086.1 | 60.41 | 10.30 | 10 | nM |
| AD-738087.1 | 12.21 | 2.15 | 10 | nM |
| AD-738088.1 | 44.49 | 10.16 | 10 | nM |
| AD-738089.1 | 31.43 | 4.82 | 10 | nM |
| AD-738090.1 | 23.34 | 5.54 | 10 | nM |
| AD-738091.1 | 35.28 | 12.92 | 10 | nM |
| AD-738092.1 | 89.59 | 18.72 | 10 | nM |
| AD-738093.1 | 71.33 | 16.07 | 10 | nM |
| AD-738094.1 | 18.69 | 3.23 | 10 | nM |
| AD-738095.1 | 30.93 | 6.90 | 10 | nM |
| AD-738096.1 | 26.70 | 5.20 | 10 | nM |
| AD-738097.1 | 65.74 | 9.99 | 10 | nM |
| AD-738098.1 | 16.18 | 4.17 | 10 | nM |
| AD-738099.1 | 48.95 | 9.69 | 10 | nM |
| AD-738100.1 | 67.26 | 11.31 | 10 | nM |
| AD-738012.1 | 17.40 | 2.53 | 1 | nM |
| AD-738013.1 | 15.51 | 2.70 | 1 | nM |
| AD-738014.1 | 23.54 | 9.95 | 1 | nM |
| AD-738015.1 | 21.35 | 2.38 | 1 | nM |
| AD-738016.1 | 20.20 | 1.90 | 1 | nM |
| AD-738017.1 | 15.67 | 2.60 | 1 | nM |
| AD-738018.1 | 17.00 | 0.80 | 1 | nM |
| AD-738019.1 | 17.58 | 7.97 | 1 | nM |
| AD-738020.1 | 15.47 | 3.64 | 1 | nM |
| AD-738021.1 | 14.81 | 4.24 | 1 | nM |
| AD-738022.1 | 13.71 | 2.86 | 1 | nM |
| AD-738023.1 | 17.33 | 4.91 | 1 | nM |
| AD-738024.1 | 20.64 | 7.04 | 1 | nM |
| AD-738025.1 | 95.81 | 28.98 | 1 | nM |
| AD-738026.1 | 28.29 | 10.28 | 1 | nM |
| AD-738027.1 | 15.94 | 3.44 | 1 | nM |
| AD-738028.1 | 25.76 | 10.62 | 1 | nM |
| AD-738029.1 | 18.83 | 6.50 | 1 | nM |
| AD-738030.1 | 30.24 | 7.29 | 1 | nM |
| AD-738031.1 | 30.77 | 6.54 | 1 | nM |
| AD-738032.1 | 25.98 | 6.57 | 1 | nM |
| AD-738033.1 | 31.28 | 8.14 | 1 | nM |
| AD-738034.1 | 25.06 | 6.27 | 1 | nM |
| AD-738035.1 | 21.67 | 1.11 | 1 | nM |
| AD-738036.1 | 32.29 | 11.81 | 1 | nM |
| AD-738037.1 | 30.77 | 5.48 | 1 | nM |
| AD-738038.1 | 19.03 | 1.00 | 1 | nM |
| AD-738039.1 | 20.25 | 5.55 | 1 | nM |
| AD-738040.1 | 51.87 | 7.09 | 1 | nM |
| AD-738041.1 | 35.67 | 8.23 | 1 | nM |
| AD-738042.1 | 33.70 | 9.34 | 1 | nM |
| AD-738043.1 | 19.76 | 3.35 | 1 | nM |
| AD-738044.1 | 43.40 | 9.46 | 1 | nM |
| AD-738045.1 | 97.99 | 13.43 | 1 | nM |
| AD-738046.1 | 112.65 | 25.09 | 1 | nM |
| AD-738047.1 | 37.50 | 4.18 | 1 | nM |
| AD-738048.1 | 23.67 | 0.94 | 1 | nM |
| AD-397217.2 | 60.11 | 7.67 | 1 | nM |
| AD-738049.1 | 20.00 | 1.41 | 1 | nM |
| AD-738050.1 | 36.49 | 7.06 | 1 | nM |
| AD-738051.1 | 27.03 | 6.08 | 1 | nM |
| AD-738052.1 | 31.82 | 7.17 | 1 | nM |
| AD-738053.1 | 14.96 | 2.91 | 1 | nM |
| AD-738054.1 | 32.00 | 5.62 | 1 | nM |
| AD-738055.1 | 27.57 | 7.73 | 1 | nM |
| AD-738056.1 | 15.16 | 0.70 | 1 | nM |
| AD-738057.1 | 14.83 | 3.32 | 1 | nM |
| AD-738058.1 | 33.09 | 9.91 | 1 | nM |
| AD-738059.1 | 26.76 | 5.77 | 1 | nM |
| AD-738060.1 | 11.79 | 2.64 | 1 | nM |
| AD-738061.1 | 28.49 | 1.35 | 1 | nM |
| AD-738062.1 | 15.89 | 6.49 | 1 | nM |
| AD-738063.1 | 25.01 | 8.31 | 1 | nM |
| AD-738064.1 | 16.91 | 2.56 | 1 | nM |
| AD-738065.1 | 15.45 | 2.85 | 1 | nM |
| AD-738066.1 | 51.85 | 8.48 | 1 | nM |
| AD-738067.1 | 20.90 | 4.96 | 1 | nM |
| AD-738068.1 | 15.82 | 2.70 | 1 | nM |
| AD-738069.1 | 81.26 | 2.84 | 1 | nM |
| AD-738070.1 | 59.48 | 11.42 | 1 | nM |
| AD-738071.1 | 15.12 | 3.89 | 1 | nM |
| AD-738072.1 | 40.16 | 7.78 | 1 | nM |
| AD-738073.1 | 18.46 | 5.20 | 1 | nM |
| AD-738074.1 | 27.74 | 1.97 | 1 | nM |
| AD-738075.1 | 83.53 | 9.94 | 1 | nM |
| AD-738076.1 | 50.62 | 3.51 | 1 | nM |
| AD-738077.1 | 21.52 | 4.49 | 1 | nM |
| AD-738078.1 | 24.49 | 10.05 | 1 | nM |
| AD-738079.1 | 8.66 | 2.69 | 1 | nM |
| AD-738080.1 | 28.88 | 1.12 | 1 | nM |
| AD-738081.1 | 77.35 | 10.22 | 1 | nM |
| AD-738082.1 | 48.10 | 10.63 | 1 | nM |
| AD-738083.1 | 23.74 | 4.60 | 1 | nM |
| AD-738084.1 | 100.84 | 2.83 | 1 | nM |
| AD-738085.1 | 101.30 | 4.73 | 1 | nM |
| AD-738086.1 | 60.29 | 24.33 | 1 | nM |
| AD-738087.1 | 9.71 | 3.71 | 1 | nM |
| AD-738088.1 | 79.16 | 7.79 | 1 | nM |
| AD-738089.1 | 35.37 | 8.78 | 1 | nM |
| AD-738090.1 | 37.16 | 13.37 | 1 | nM |
| AD-738091.1 | 49.56 | 10.83 | 1 | nM |
| AD-738092.1 | 79.50 | 10.15 | 1 | nM |
| AD-738093.1 | 96.42 | 16.26 | 1 | nM |
| AD-738094.1 | 41.63 | 5.90 | 1 | nM |
| AD-738095.1 | 45.03 | 8.10 | 1 | nM |
| AD-738096.1 | 44.52 | 11.55 | 1 | nM |
| AD-738097.1 | 78.88 | 13.42 | 1 | nM |
| AD-738098.1 | 28.84 | 8.43 | 1 | nM |
| AD-738099.1 | 68.10 | 16.73 | 1 | nM |
| AD-738100.1 | 84.53 | 5.73 | 1 | nM |
| AD-738012.1 | 35.64 | 12.05 | 0.1 | nM |
| AD-738013.1 | 29.76 | 5.05 | 0.1 | nM |
| AD-738014.1 | 47.17 | 13.55 | 0.1 | nM |
| AD-738015.1 | 35.51 | 13.38 | 0.1 | nM |
| AD-738016.1 | 38.17 | 9.76 | 0.1 | nM |
| AD-738017.1 | 30.03 | 7.04 | 0.1 | nM |
| AD-738018.1 | 20.38 | 4.76 | 0.1 | nM |
| AD-738019.1 | 30.10 | 4.89 | 0.1 | nM |
| AD-738020.1 | 44.67 | 8.48 | 0.1 | nM |
| AD-738021.1 | 30.05 | 5.88 | 0.1 | nM |
| AD-738022.1 | 30.24 | 5.96 | 0.1 | nM |
| AD-738023.1 | 25.74 | 7.75 | 0.1 | nM |
| AD-738024.1 | 31.43 | 10.51 | 0.1 | nM |
| AD-738025.1 | 112.57 | 14.24 | 0.1 | nM |
| AD-738026.1 | 54.28 | 6.70 | 0.1 | nM |
| AD-738027.1 | 26.02 | 4.95 | 0.1 | nM |

TABLE 17-continued

APP Dose Screen Study in Be(2)C Cell Lines at 10 nM, 1 nM, and 0.1 nM

| Duplex | Average message remaining (%) | Standard Deviation | Dose | Dose Unit |
|---|---|---|---|---|
| AD-738028.1 | 35.82 | 10.41 | 0.1 | nM |
| AD-738029.1 | 40.29 | 3.76 | 0.1 | nM |
| AD-738030.1 | 51.38 | 24.04 | 0.1 | nM |
| AD-738031.1 | 40.78 | 11.79 | 0.1 | nM |
| AD-738032.1 | 47.97 | 6.74 | 0.1 | nM |
| AD-738033.1 | 38.57 | 7.04 | 0.1 | nM |
| AD-738034.1 | 46.53 | 13.21 | 0.1 | nM |
| AD-738035.1 | 43.04 | 12.39 | 0.1 | nM |
| AD-738036.1 | 43.08 | 3.41 | 0.1 | nM |
| AD-738037.1 | 87.09 | 39.32 | 0.1 | nM |
| AD-738038.1 | 64.97 | 3.06 | 0.1 | nM |
| AD-738039.1 | 74.15 | 30.96 | 0.1 | nM |
| AD-738040.1 | 159.41 | 39.34 | 0.1 | nM |
| AD-738041.1 | 108.29 | 36.98 | 0.1 | nM |
| AD-738042.1 | 69.15 | 28.46 | 0.1 | nM |
| AD-738043.1 | 45.00 | 17.66 | 0.1 | nM |
| AD-738044.1 | 88.04 | 17.84 | 0.1 | nM |
| AD-738045.1 | 238.11 | 15.24 | 0.1 | nM |
| AD-738046.1 | 259.68 | 3.44 | 0.1 | nM |
| AD-738047.1 | 136.91 | 44.65 | 0.1 | nM |
| AD-738048.1 | 131.72 | 13.39 | 0.1 | nM |
| AD-397217.2 | 222.75 | 51.71 | 0.1 | nM |
| AD-738049.1 | 65.58 | 6.12 | 0.1 | nM |
| AD-738050.1 | 63.97 | 11.64 | 0.1 | nM |
| AD-738051.1 | 89.72 | 27.54 | 0.1 | nM |
| AD-738052.1 | 140.07 | 36.18 | 0.1 | nM |
| AD-738053.1 | 77.09 | 14.75 | 0.1 | nM |
| AD-738054.1 | 205.91 | 46.37 | 0.1 | nM |
| AD-738055.1 | 197.02 | 44.70 | 0.1 | nM |
| AD-738056.1 | 85.09 | 14.19 | 0.1 | nM |
| AD-738057.1 | 87.72 | 18.23 | 0.1 | nM |
| AD-738058.1 | 164.40 | 24.71 | 0.1 | nM |
| AD-738059.1 | 129.01 | 9.61 | 0.1 | nM |
| AD-738060.1 | 63.48 | 35.21 | 0.1 | nM |
| AD-738061.1 | 191.48 | 13.85 | 0.1 | nM |
| AD-738062.1 | 108.14 | 8.70 | 0.1 | nM |
| AD-738063.1 | 100.27 | 16.53 | 0.1 | nM |
| AD-738064.1 | 46.78 | 12.88 | 0.1 | nM |
| AD-738065.1 | 84.72 | 11.97 | 0.1 | nM |
| AD-738066.1 | 218.00 | 48.39 | 0.1 | nM |
| AD-738067.1 | 123.65 | 34.39 | 0.1 | nM |
| AD-738068.1 | 90.93 | 17.12 | 0.1 | nM |
| AD-738069.1 | 300.08 | 12.73 | 0.1 | nM |
| AD-738070.1 | 238.24 | 7.61 | 0.1 | nM |
| AD-738071.1 | 46.50 | 1.25 | 0.1 | nM |
| AD-738072.1 | 58.01 | 21.95 | 0.1 | nM |
| AD-738073.1 | 68.05 | 19.98 | 0.1 | nM |
| AD-738074.1 | 134.77 | 30.73 | 0.1 | nM |
| AD-738075.1 | 328.84 | 50.48 | 0.1 | nM |
| AD-738076.1 | 237.89 | 30.07 | 0.1 | nM |
| AD-738077.1 | 108.45 | 14.70 | 0.1 | nM |
| AD-738078.1 | 127.49 | 44.03 | 0.1 | nM |
| AD-738079.1 | 46.06 | 9.44 | 0.1 | nM |
| AD-738080.1 | 57.45 | 19.09 | 0.1 | nM |
| AD-738081.1 | 147.89 | 27.56 | 0.1 | nM |
| AD-738082.1 | 169.52 | 28.01 | 0.1 | nM |
| AD-738083.1 | 106.74 | 6.93 | 0.1 | nM |
| AD-738084.1 | 242.62 | 60.78 | 0.1 | nM |
| AD-738085.1 | 295.62 | 32.59 | 0.1 | nM |
| AD-738086.1 | 221.56 | 21.04 | 0.1 | nM |
| AD-738087.1 | 82.58 | 14.78 | 0.1 | nM |
| AD-738088.1 | 88.52 | 10.41 | 0.1 | nM |
| AD-738089.1 | 84.36 | 20.12 | 0.1 | nM |
| AD-738090.1 | 120.67 | 19.87 | 0.1 | nM |
| AD-738091.1 | 180.61 | 14.25 | 0.1 | nM |
| AD-738092.1 | 240.22 | 16.63 | 0.1 | nM |
| AD-738093.1 | 303.63 | 8.82 | 0.1 | nM |
| AD-738094.1 | 146.42 | 25.16 | 0.1 | nM |
| AD-738095.1 | 124.16 | 57.91 | 0.1 | nM |
| AD-738096.1 | 56.53 | 8.58 | 0.1 | nM |
| AD-738097.1 | 116.46 | 38.97 | 0.1 | nM |
| AD-738098.1 | 59.28 | 19.71 | 0.1 | nM |
| AD-738099.1 | 149.49 | 42.85 | 0.1 | nM |
| AD-738100.1 | 89.06 | 17.49 | 0.1 | nM |

Table 18 summarizes results from a multi-dose APP screen in Neuro2A cells conducted at either 10 nM, 1 nM or 0.1 nM. Data are expressed as percent message remaining relative to AD-1955 non-targeting control

TABLE 18

APP Dose Screen Study in Neuro2A Cell Lines at 10 nM, 1 nM, and 0.1 nM.

| Duplex | Average | Standard Deviation | Dose | Dose Unit |
|---|---|---|---|---|
| AD-738012.1 | 0.11 | 0.07 | 10 | nM |
| AD-738013.1 | 0.20 | 0.06 | 10 | nM |
| AD-738014.1 | 1.12 | 0.42 | 10 | nM |
| AD-738015.1 | 1.72 | 1.20 | 10 | nM |
| AD-738016.1 | 0.98 | 0.31 | 10 | nM |
| AD-738017.1 | 0.32 | 0.24 | 10 | nM |
| AD-738018.1 | 0.14 | 0.07 | 10 | nM |
| AD-738019.1 | 0.63 | 0.25 | 10 | nM |
| AD-738020.1 | 0.11 | 0.08 | 10 | nM |
| AD-738021.1 | 1.20 | 0.52 | 10 | nM |
| AD-738022.1 | 1.86 | 0.95 | 10 | nM |
| AD-738023.1 | 1.18 | 0.53 | 10 | nM |
| AD-738024.1 | 3.13 | 1.81 | 10 | nM |
| AD-738025.1 | 11.77 | 3.21 | 10 | nM |
| AD-738026.1 | 0.81 | 0.44 | 10 | nM |
| AD-738027.1 | 0.23 | 0.10 | 10 | nM |
| AD-738028.1 | 0.15 | 0.15 | 10 | nM |
| AD-738029.1 | 1.48 | 0.93 | 10 | nM |
| AD-738030.1 | 1.45 | 0.99 | 10 | nM |
| AD-738031.1 | 2.72 | 0.68 | 10 | nM |
| AD-738032.1 | 3.04 | 0.84 | 10 | nM |
| AD-738033.1 | 2.71 | 0.98 | 10 | nM |
| AD-738034.1 | 4.98 | 3.47 | 10 | nM |
| AD-738035.1 | 1.51 | 0.77 | 10 | nM |
| AD-738036.1 | 1.18 | 1.21 | 10 | nM |
| AD-738037.1 | 2.87 | 1.38 | 10 | nM |
| AD-738038.1 | 1.52 | 0.43 | 10 | nM |
| AD-738039.1 | 5.43 | 2.42 | 10 | nM |
| AD-738040.1 | 12.15 | 3.03 | 10 | nM |
| AD-738041.1 | 4.14 | 2.38 | 10 | nM |
| AD-738042.1 | 4.41 | 2.78 | 10 | nM |
| AD-738043.1 | 0.67 | 0.51 | 10 | nM |
| AD-738044.1 | 1.21 | 0.74 | 10 | nM |
| AD-738045.1 | 21.32 | 2.05 | 10 | nM |
| AD-738046.1 | 8.41 | 3.63 | 10 | nM |
| AD-738047.1 | 1.92 | 1.96 | 10 | nM |
| AD-738048.1 | 0.83 | 0.24 | 10 | nM |
| AD-397217.2 | 14.29 | 4.68 | 10 | nM |
| AD-738049.1 | 4.40 | 2.05 | 10 | nM |
| AD-738050.1 | 1.46 | 0.17 | 10 | nM |
| AD-738051.1 | 1.48 | 1.43 | 10 | nM |
| AD-738052.1 | 4.60 | 0.68 | 10 | nM |
| AD-738053.1 | 3.92 | 1.90 | 10 | nM |
| AD-738054.1 | 6.95 | 1.84 | 10 | nM |
| AD-738055.1 | 2.82 | 0.53 | 10 | nM |
| AD-738056.1 | 4.83 | 3.07 | 10 | nM |
| AD-738057.1 | 4.79 | 3.01 | 10 | nM |
| AD-738058.1 | 12.43 | 4.84 | 10 | nM |
| AD-738059.1 | 5.66 | 1.40 | 10 | nM |
| AD-738060.1 | 4.24 | 0.94 | 10 | nM |

TABLE 18-continued

APP Dose Screen Study in Neuro2A Cell Lines at 10 nM, 1 nM, and 0.1 nM.

| Duplex | Average | Standard Deviation | Dose | Dose Unit |
|---|---|---|---|---|
| AD-738061.1 | 10.85 | 2.10 | 10 | nM |
| AD-738062.1 | 1.34 | 0.51 | 10 | nM |
| AD-738063.1 | 31.40 | 6.43 | 10 | nM |
| AD-738064.1 | 0.77 | 0.71 | 10 | nM |
| AD-738065.1 | 6.43 | 1.80 | 10 | nM |
| AD-738066.1 | 30.73 | 12.64 | 10 | nM |
| AD-738067.1 | 3.79 | 0.76 | 10 | nM |
| AD-738068.1 | 4.60 | 1.19 | 10 | nM |
| AD-738069.1 | 36.14 | 12.51 | 10 | nM |
| AD-738070.1 | 34.99 | 13.86 | 10 | nM |
| AD-738071.1 | 1.84 | 1.71 | 10 | nM |
| AD-738072.1 | 1.29 | 1.22 | 10 | nM |
| AD-738073.1 | 0.65 | 0.14 | 10 | nM |
| AD-738074.1 | 1.28 | 0.51 | 10 | nM |
| AD-738075.1 | 75.00 | 22.72 | 10 | nM |
| AD-738076.1 | 19.31 | 2.56 | 10 | nM |
| AD-738077.1 | 5.21 | 1.66 | 10 | nM |
| AD-738078.1 | 7.24 | 5.26 | 10 | nM |
| AD-738079.1 | 1.64 | 0.72 | 10 | nM |
| AD-738080.1 | 2.17 | 1.31 | 10 | nM |
| AD-738081.1 | 13.03 | 2.64 | 10 | nM |
| AD-738082.1 | 3.37 | 1.05 | 10 | nM |
| AD-738083.1 | 5.36 | 2.87 | 10 | nM |
| AD-738084.1 | 22.04 | 7.85 | 10 | nM |
| AD-738085.1 | 6.81 | 1.80 | 10 | nM |
| AD-738086.1 | 35.05 | 12.18 | 10 | nM |
| AD-738087.1 | 0.14 | 0.10 | 10 | nM |
| AD-738088.1 | 34.43 | 18.92 | 10 | nM |
| AD-738089.1 | 11.16 | 1.48 | 10 | nM |
| AD-738090.1 | 4.55 | 0.77 | 10 | nM |
| AD-738091.1 | 9.04 | 2.02 | 10 | nM |
| AD-738092.1 | 48.12 | 5.51 | 10 | nM |
| AD-738093.1 | 47.41 | 11.32 | 10 | nM |
| AD-738094.1 | 25.25 | 3.17 | 10 | nM |
| AD-738095.1 | 8.80 | 1.79 | 10 | nM |
| AD-738096.1 | 4.36 | 5.22 | 10 | nM |
| AD-738097.1 | 28.80 | 6.91 | 10 | nM |
| AD-738098.1 | 10.91 | 3.70 | 10 | nM |
| AD-738099.1 | 25.30 | 5.42 | 10 | nM |
| AD-738100.1 | 43.27 | 10.46 | 10 | nM |
| AD-738012.1 | 3.70 | 3.79 | 1 | nM |
| AD-738013.1 | 6.87 | 3.98 | 1 | nM |
| AD-738014.1 | 16.20 | 4.78 | 1 | nM |
| AD-738015.1 | 15.97 | 3.04 | 1 | nM |
| AD-738016.1 | 11.33 | 4.08 | 1 | nM |
| AD-738017.1 | 3.91 | 2.43 | 1 | nM |
| AD-738018.1 | 9.79 | 5.33 | 1 | nM |
| AD-738019.1 | 5.90 | 4.65 | 1 | nM |
| AD-738020.1 | 4.29 | 7.33 | 1 | nM |
| AD-738021.1 | 11.55 | 7.48 | 1 | nM |
| AD-738022.1 | 12.06 | 4.21 | 1 | nM |
| AD-738023.1 | 10.50 | 4.50 | 1 | nM |
| AD-738024.1 | 12.71 | 3.60 | 1 | nM |
| AD-738025.1 | 42.61 | 8.91 | 1 | nM |
| AD-738026.1 | 7.13 | 2.81 | 1 | nM |
| AD-738027.1 | 1.14 | 0.44 | 1 | nM |
| AD-738028.1 | 2.99 | 4.01 | 1 | nM |
| AD-738029.1 | 8.81 | 4.91 | 1 | nM |
| AD-738030.1 | 15.88 | 4.68 | 1 | nM |
| AD-738031.1 | 14.42 | 9.04 | 1 | nM |
| AD-738032.1 | 12.11 | 3.28 | 1 | nM |
| AD-738033.1 | 17.47 | 13.61 | 1 | nM |
| AD-738034.1 | 18.58 | 6.98 | 1 | nM |
| AD-738035.1 | 7.64 | 6.58 | 1 | nM |
| AD-738036.1 | 2.84 | 2.90 | 1 | nM |
| AD-738037.1 | 11.17 | 3.62 | 1 | nM |
| AD-738038.1 | 10.23 | 4.82 | 1 | nM |
| AD-738039.1 | 9.61 | 2.76 | 1 | nM |
| AD-738040.1 | 54.47 | 14.10 | 1 | nM |
| AD-738041.1 | 15.86 | 6.31 | 1 | nM |
| AD-738042.1 | 15.96 | 6.61 | 1 | nM |
| AD-738043.1 | 2.26 | 2.61 | 1 | nM |
| AD-738044.1 | 4.54 | 4.76 | 1 | nM |
| AD-738045.1 | 25.51 | 7.28 | 1 | nM |
| AD-738046.1 | 30.32 | 10.02 | 1 | nM |
| AD-738047.1 | 16.25 | 7.68 | 1 | nM |
| AD-738048.1 | 9.07 | 3.25 | 1 | nM |
| AD-397217.2 | 48.16 | 12.70 | 1 | nM |
| AD-738049.1 | 7.97 | 3.33 | 1 | nM |
| AD-738050.1 | 5.60 | 4.81 | 1 | nM |
| AD-738051.1 | 1.49 | 1.05 | 1 | nM |
| AD-738052.1 | 10.13 | 2.72 | 1 | nM |
| AD-738053.1 | 10.82 | 4.44 | 1 | nM |
| AD-738054.1 | 21.52 | 8.71 | 1 | nM |
| AD-738055.1 | 12.40 | 3.31 | 1 | nM |
| AD-738056.1 | 5.93 | 4.14 | 1 | nM |
| AD-738057.1 | 7.63 | 2.80 | 1 | nM |
| AD-738058.1 | 18.21 | 4.26 | 1 | nM |
| AD-738059.1 | 14.39 | 6.00 | 1 | nM |
| AD-738060.1 | 6.71 | 2.99 | 1 | nM |
| AD-738061.1 | 13.63 | 3.65 | 1 | nM |
| AD-738062.1 | 6.08 | 3.37 | 1 | nM |
| AD-738063.1 | 9.63 | 8.05 | 1 | nM |
| AD-738064.1 | 6.51 | 4.83 | 1 | nM |
| AD-738065.1 | 9.97 | 1.82 | 1 | nM |
| AD-738066.1 | 50.95 | 5.44 | 1 | nM |
| AD-738067.1 | 9.69 | 2.74 | 1 | nM |
| AD-738068.1 | 9.39 | 1.51 | 1 | nM |
| AD-738069.1 | 43.67 | 8.07 | 1 | nM |
| AD-738070.1 | 37.85 | 4.96 | 1 | nM |
| AD-738071.1 | 2.81 | 2.93 | 1 | nM |
| AD-738072.1 | 10.65 | 9.82 | 1 | nM |
| AD-738073.1 | 5.64 | 2.45 | 1 | nM |
| AD-738074.1 | 10.00 | 4.11 | 1 | nM |
| AD-738075.1 | 78.16 | 11.76 | 1 | nM |
| AD-738076.1 | 44.11 | 8.21 | 1 | nM |
| AD-738077.1 | 11.42 | 0.98 | 1 | nM |
| AD-738078.1 | 7.65 | 1.23 | 1 | nM |
| AD-738079.1 | 1.78 | 2.66 | 1 | nM |
| AD-738080.1 | 7.03 | 8.36 | 1 | nM |
| AD-738081.1 | 27.43 | 6.11 | 1 | nM |
| AD-738082.1 | 21.57 | 4.04 | 1 | nM |
| AD-738083.1 | 10.77 | 3.72 | 1 | nM |
| AD-738084.1 | 76.60 | 10.91 | 1 | nM |
| AD-738085.1 | 36.65 | 7.82 | 1 | nM |
| AD-738086.1 | 26.34 | 11.70 | 1 | nM |
| AD-738087.1 | 0.56 | 0.52 | 1 | nM |
| AD-738088.1 | 52.50 | 10.17 | 1 | nM |
| AD-738089.1 | 12.77 | 1.25 | 1 | nM |
| AD-738090.1 | 12.92 | 5.28 | 1 | nM |
| AD-738091.1 | 20.70 | 1.73 | 1 | nM |
| AD-738092.1 | 58.85 | 6.24 | 1 | nM |
| AD-738093.1 | 84.82 | 9.95 | 1 | nM |
| AD-738094.1 | 59.17 | 6.38 | 1 | nM |
| AD-738095.1 | 12.86 | 8.99 | 1 | nM |
| AD-738096.1 | 10.61 | 4.77 | 1 | nM |
| AD-738097.1 | 35.98 | 1.81 | 1 | nM |
| AD-738098.1 | 14.76 | 3.12 | 1 | nM |
| AD-738099.1 | 37.99 | 2.57 | 1 | nM |
| AD-738100.1 | 46.62 | 7.08 | 1 | nM |
| AD-738012.1 | 11.95 | 6.41 | 0.1 | nM |
| AD-738013.1 | 11.70 | 2.86 | 0.1 | nM |
| AD-738014.1 | 33.48 | 9.61 | 0.1 | nM |
| AD-738015.1 | 25.02 | 5.00 | 0.1 | nM |
| AD-738016.1 | 22.29 | 4.67 | 0.1 | nM |
| AD-738017.1 | 21.12 | 5.92 | 0.1 | nM |
| AD-738018.1 | 15.82 | 5.90 | 0.1 | nM |
| AD-738019.1 | 22.54 | 18.17 | 0.1 | nM |
| AD-738020.1 | 12.05 | 9.08 | 0.1 | nM |

TABLE 18-continued

APP Dose Screen Study in Neuro2A Cell Lines at 10 nM, 1 nM, and 0.1 nM.

| Duplex | Average | Standard Deviation | Dose | Dose Unit |
|---|---|---|---|---|
| AD-738021.1 | 19.21 | 0.85 | 0.1 | nM |
| AD-738022.1 | 24.55 | 5.38 | 0.1 | nM |
| AD-738023.1 | 17.43 | 5.05 | 0.1 | nM |
| AD-738024.1 | 24.48 | 1.96 | 0.1 | nM |
| AD-738025.1 | 72.34 | 16.04 | 0.1 | nM |
| AD-738026.1 | 44.09 | 2.91 | 0.1 | nM |
| AD-738027.1 | 16.46 | 9.70 | 0.1 | nM |
| AD-738028.1 | 13.92 | 9.68 | 0.1 | nM |
| AD-738029.1 | 25.75 | 5.87 | 0.1 | nM |
| AD-738030.1 | 42.80 | 8.11 | 0.1 | nM |
| AD-738031.1 | 43.85 | 2.58 | 0.1 | nM |
| AD-738032.1 | 29.64 | 6.11 | 0.1 | nM |
| AD-738033.1 | 42.40 | 1.69 | 0.1 | nM |
| AD-738034.1 | 49.71 | 3.53 | 0.1 | nM |
| AD-738035.1 | 30.30 | 20.42 | 0.1 | nM |
| AD-738036.1 | 12.98 | 4.90 | 0.1 | nM |
| AD-738037.1 | 13.01 | 5.34 | 0.1 | nM |
| AD-738038.1 | 15.19 | 8.17 | 0.1 | nM |
| AD-738039.1 | 18.24 | 10.33 | 0.1 | nM |
| AD-738040.1 | 60.24 | 13.10 | 0.1 | nM |
| AD-738041.1 | 26.49 | 7.47 | 0.1 | nM |
| AD-738042.1 | 18.54 | 6.11 | 0.1 | nM |
| AD-738043.1 | 5.91 | 5.08 | 0.1 | nM |
| AD-738044.1 | 14.74 | 6.15 | 0.1 | nM |
| AD-738045.1 | 55.58 | 16.72 | 0.1 | nM |
| AD-738046.1 | 68.30 | 11.74 | 0.1 | nM |
| AD-738047.1 | 40.80 | 6.70 | 0.1 | nM |
| AD-738048.1 | 32.28 | 7.47 | 0.1 | nM |
| AD-397217.2 | 76.28 | 11.27 | 0.1 | nM |
| AD-738049.1 | 22.10 | 8.60 | 0.1 | nM |
| AD-738050.1 | 8.56 | 5.26 | 0.1 | nM |
| AD-738051.1 | 19.62 | 9.00 | 0.1 | nM |
| AD-738052.1 | 29.60 | 6.17 | 0.1 | nM |
| AD-738053.1 | 19.82 | 6.73 | 0.1 | nM |
| AD-738054.1 | 48.02 | 6.33 | 0.1 | nM |
| AD-738055.1 | 26.00 | 8.90 | 0.1 | nM |
| AD-738056.1 | 34.85 | 7.55 | 0.1 | nM |
| AD-738057.1 | 30.60 | 9.35 | 0.1 | nM |
| AD-738058.1 | 49.45 | 11.76 | 0.1 | nM |
| AD-738059.1 | 40.24 | 4.74 | 0.1 | nM |
| AD-738060.1 | 37.94 | 10.19 | 0.1 | nM |
| AD-738061.1 | 49.79 | 3.08 | 0.1 | nM |
| AD-738062.1 | 28.19 | 1.51 | 0.1 | nM |
| AD-738063.1 | 30.80 | 15.24 | 0.1 | nM |
| AD-738064.1 | 25.32 | 2.67 | 0.1 | nM |
| AD-738065.1 | 34.43 | 9.76 | 0.1 | nM |
| AD-738066.1 | 87.77 | 14.39 | 0.1 | nM |
| AD-738067.1 | 36.47 | 9.15 | 0.1 | nM |
| AD-738068.1 | 28.08 | 4.14 | 0.1 | nM |
| AD-738069.1 | 97.43 | 7.31 | 0.1 | nM |
| AD-738070.1 | 82.37 | 8.24 | 0.1 | nM |
| AD-738071.1 | 27.61 | 7.94 | 0.1 | nM |
| AD-738072.1 | 37.34 | 2.31 | 0.1 | nM |
| AD-738073.1 | 25.85 | 9.17 | 0.1 | nM |
| AD-738074.1 | 41.19 | 13.50 | 0.1 | nM |
| AD-738075.1 | 93.48 | 11.50 | 0.1 | nM |
| AD-738076.1 | 66.05 | 10.10 | 0.1 | nM |
| AD-738077.1 | 32.71 | 5.69 | 0.1 | nM |
| AD-738078.1 | 35.64 | 5.42 | 0.1 | nM |
| AD-738079.1 | 20.48 | 3.52 | 0.1 | nM |
| AD-738080.1 | 36.41 | 7.72 | 0.1 | nM |
| AD-738081.1 | 65.34 | 19.91 | 0.1 | nM |
| AD-738082.1 | 53.82 | 8.31 | 0.1 | nM |
| AD-738083.1 | 30.04 | 5.11 | 0.1 | nM |
| AD-738084.1 | 88.32 | 9.40 | 0.1 | nM |
| AD-738085.1 | 78.53 | 7.08 | 0.1 | nM |
| AD-738086.1 | 82.59 | 7.90 | 0.1 | nM |
| AD-738087.1 | 13.94 | 6.27 | 0.1 | nM |
| AD-738088.1 | 73.47 | 18.72 | 0.1 | nM |
| AD-738089.1 | 48.21 | 8.12 | 0.1 | nM |
| AD-738090.1 | 43.23 | 12.93 | 0.1 | nM |
| AD-738091.1 | 52.45 | 4.67 | 0.1 | nM |
| AD-738092.1 | 75.75 | 31.47 | 0.1 | nM |
| AD-738093.1 | 88.99 | 10.31 | 0.1 | nM |
| AD-738094.1 | 82.41 | 6.94 | 0.1 | nM |
| AD-738095.1 | 51.05 | 7.29 | 0.1 | nM |
| AD-738096.1 | 31.49 | 12.31 | 0.1 | nM |
| AD-738097.1 | 64.39 | 13.12 | 0.1 | nM |
| AD-738098.1 | 33.73 | 10.09 | 0.1 | nM |
| AD-738099.1 | 69.09 | 9.27 | 0.1 | nM |
| AD-738100.1 | 75.77 | 15.74 | 0.1 | nM |

Example 6. In Vivo APP Screening of Sequences with AU-Rich Seeds

Figure 14A:
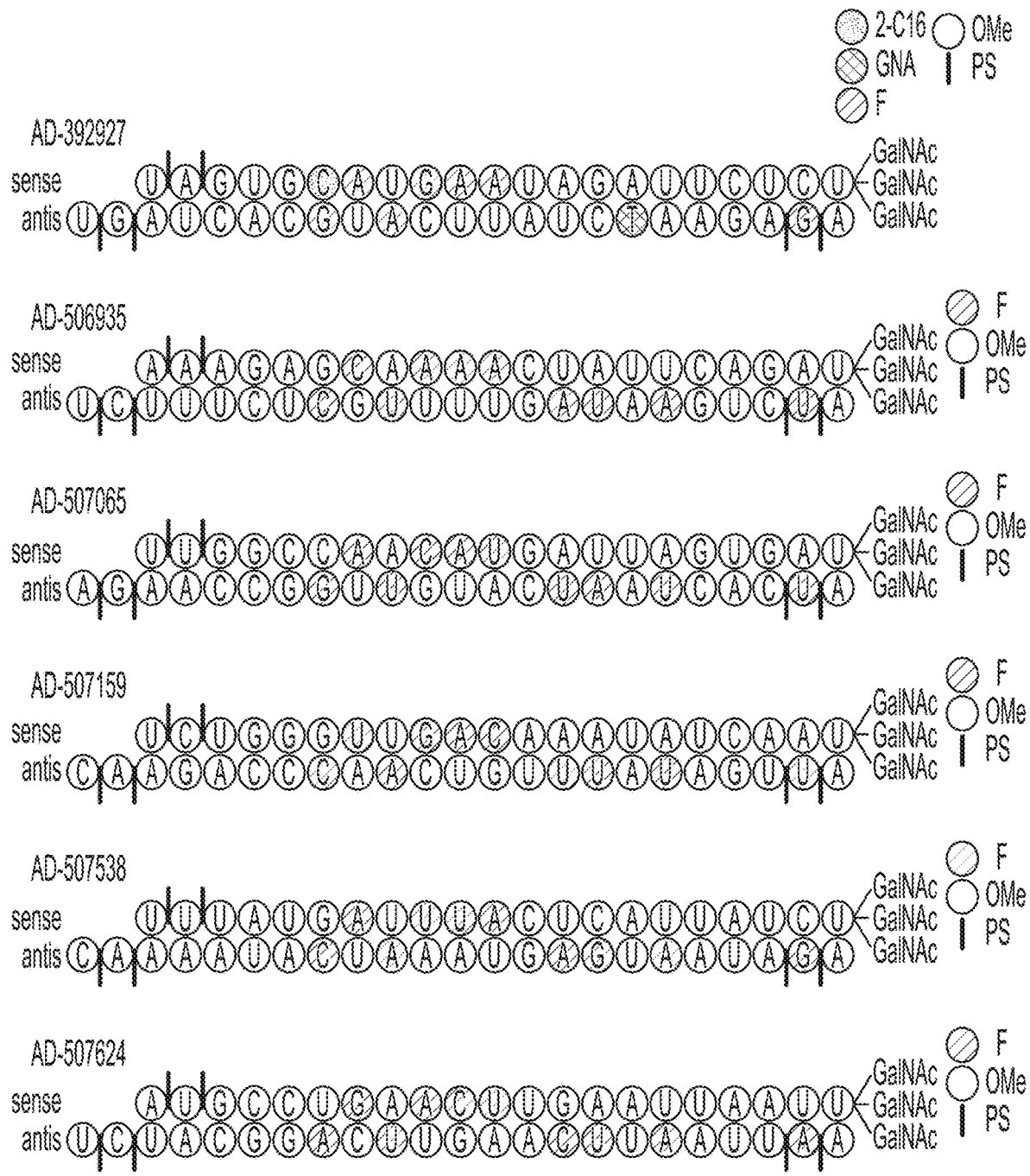
FIG. 14A and FIG. 14B are schematic images of modified RNAi agents having AU-rich seeds that were screened for in vivo hsAPP knockdown activity in mice. The agents include AD-392927 (sense strand SEQ ID NO:1141; antisense strand SEQ ID NO:1142), AD-506935 (sense strand SEQ ID NO:1916; antisense strand SEQ ID NO:1917), AD-507065 (sense strand SEQ ID NO:1918; antisense strand SEQ ID NO:1919), AD-507159 (sense strand SEQ ID NO:1920; antisense strand SEQ ID NO:1921), AD-507538 (sense strand SEQ ID NO:1922; antisense strand SEQ ID NO:1923), AD-507624 (sense strand SEQ ID NO:1924; antisense strand SEQ ID NO:1925), AD-507724 (sense strand SEQ ID NO:1926; antisense strand SEQ ID NO:1927), AD-507725 (sense strand SEQ ID NO:1928; antisense strand SEQ ID NO:1929), AD-507789 (sense strand SEQ ID NO:1930; antisense strand SEQ ID NO:1931), AD-507874 (sense strand SEQ ID NO:1932; antisense strand SEQ ID NO:1933), AD-507928 (sense strand SEQ ID NO:1934; antisense strand SEQ ID NO:1935), and AD-507949 (sense strand SEQ ID NO:1936; antisense strand SEQ ID NO:1937).
Figure 14B:
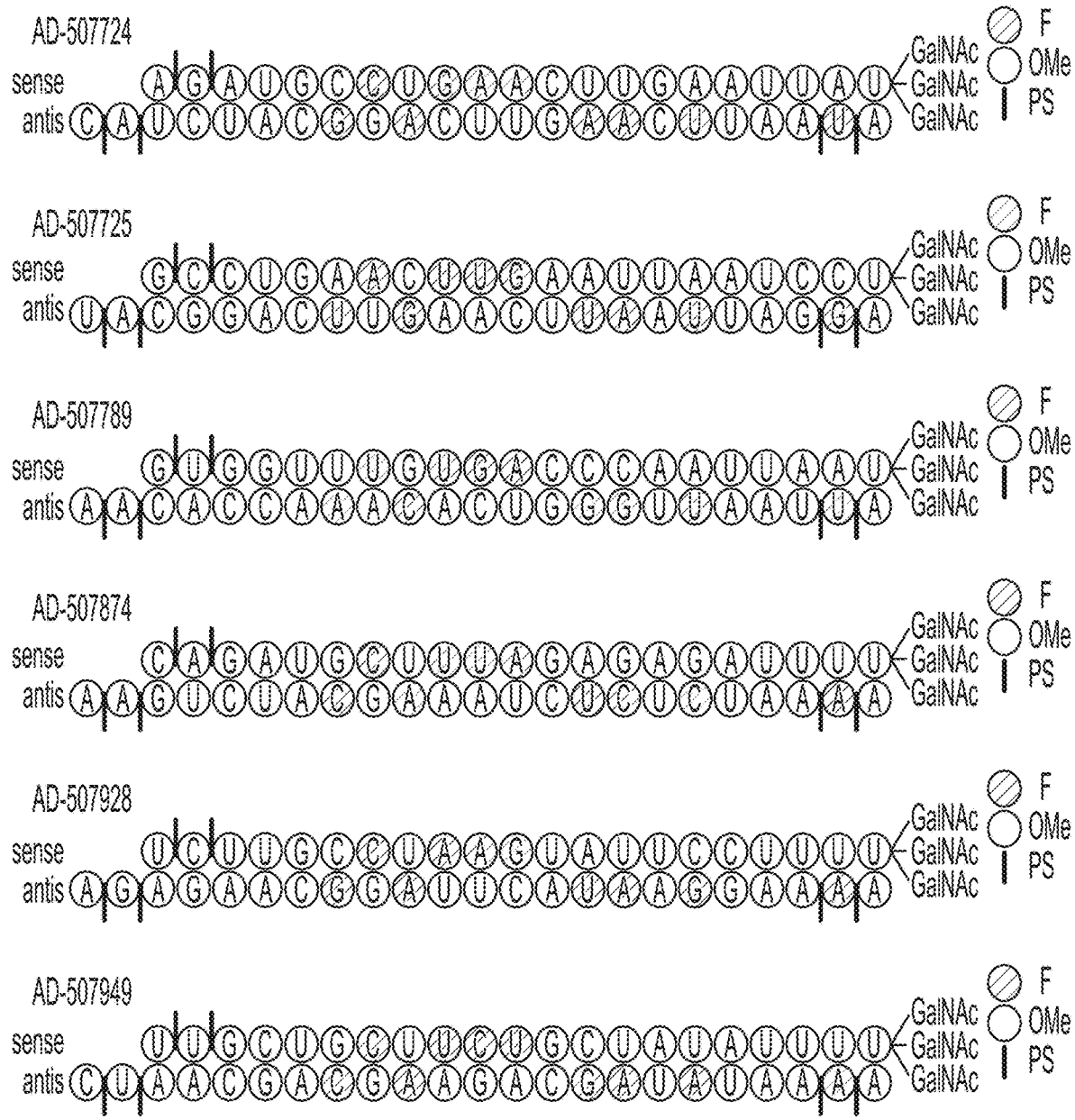

In vivo screening was performed on C57BL/6 mice to test oligonucleotides having AU-rich seeds. A summary of the study design is presented in Table 19. As shown in Table 20A, the following oligonucleotides having AU-rich seeds were tested: AD-506935.2, AD-507065.2, AD-507159.2, AD-507538.2, AD-507624.2, AD-507724.2, AD-507725.2, AD-507789.2, AD-507874.2, AD-507928.2, and AD-507949.2. Table 20A enumerates the sense, antisense, and target oligonucleotide sequences for each of these AU-rich oligonucleotides. The oligonucleotide AD-392927.2 (GNAT C16 chemistry) from RLD592 was used as a positive control sequence. The structures of the AU-rich oligonucleotides are shown in FIGS. 14A and 14B. Additionally, each of the oligonucleotides having AU-rich seeds was tested for cross-reactivity in human (e.g., assayed via the NM_000484 sequence), cynomolgus monkey (assayed via the XM_005548883 sequence), mouse (assayed via the NM_001198823 sequence), rat (assayed via the NM_019288 sequence), and dog (assayed via the NM_001293279 sequence), and this data is summarized in Table 20B.

TABLE 19

Study Design

| | | |
|---|---|---|
| Overview | In vitro rep | 646 APP NM_201414.2 |
| | Target | hsAPP |
| | Goal | In vivo screen of sequences with AU-rich seeds |
| AAV | Name | AAV8.HsAPP-CDS3TRNC VCAV-04731 |
| | Dose | 2E+11 |
| | Injection method | IV (retro orbital) |
| siRNA | Injection method | Subcutaneous |
| | Dose | 3 mg/kg |
| | Sample | Liver |
| | Collection days | D 14 |
| Animals | Sex | Female |
| | Strain | C57BL/6 |
| | Age (on arrival) | 6-8 weeks |
| | Vendor | Charles River |
| | Duplex No. | 12* |
| | n= | 3 |
| | Total animals | 45 |
| Analysis | Analysis method | RT-qPCR |
| | Taqman probe | APP: Hs00169098_m1 (FAM) Mouse GAPDH Applied Biosystems 4351309 (VIC) |
| Misc. | Controls | *AD-392927.2 from RLD592 was included as positive control |

TABLE 20 hsAPP Duplex and Target Sequences for GNA7 C16 control and AU-rich Candidates.

| Chemistry (Target) | Duplex Name | Sense Sequence (5' to 3') | SEQ ID NO | Antisense Sequence (5' to 3') | SEQ ID NO | mRNA target sequence (5' to 3') | SEQ ID NO |
|---|---|---|---|---|---|---|---|
| GNA7 C16 (APP) | AD-392927.2 | usasgug(Chd)AfuGfAfAfuagauucucuL96 | 2750 | asGfsagaa(Tgn)cuaucAfuGfcacuasgsu | 2751 | n/a | n/a |
| AU-rich seed (APP) | AD-506935.2 | asasagagCfaAfAfAfcuauucagauL96 | 2752 | asUfscugAfaUfAfguuuUfgCfucuuuscsu | 2753 | AGAAAGAGCAAAACUAUUCAGAU | 2754 |
| AU-rich seed (APP) | AD-507065.2 | ususggccAfaCfAfUfgauuagugauL96 | 2755 | asUfscacUfaAfUfcaugUfuGfgccaasgsa | 2756 | UCUUGGCCAACAUGAUUAGUGAA | 2757 |
| AU-rich seed (APP) | AD-507159.2 | uscsugggUfuGfAfCfaaauaucaauL96 | 2758 | asUfsugaUfaAfUfuguсAfaCfccagasasc | 2759 | GUUCUGGGUUGACAAAUAUCAAG | 2760 |
| AU-rich seed (APP) | AD-507538.2 | ususuaugAfnUfUfAfcucauuaucuL96 | 2761 | asGfsauaAfuGfAfguaaAfuCfauaaasasc | 2762 | GUUUUAUGAUUUACUCAUUAUCG | 2763 |
| AU-rich seed (APP) | AD-507624.2 | asusgccuGfaAfCfUfugaauuaauuL96 | 2764 | asAfsuuaAfnUfCfaaguUfcAfggcauscsu | 2765 | AGAUGCCUGAACUUGAAUUAAUC | 2766 |
| AU-rich seed (APP) | AD-507724.2 | asgsaugcCfuGfAfAfcuugaauuauL96 | 2767 | asUfsaauUfcAfAfguucAfgGfcaucusasc | 2768 | GUAGAUGCCUGAACUUGAAUUAA | 2769 |
| AU-rich seed (APP) | AD-507725.2 | gscscugaAfcUfUfGfaauuaaucuL96 | 2770 | asGfsgauUfaAfUfucaaGfuUfcaggcsasu | 2771 | AUGCCUGAACUUGAAUUAAUCCA | 2772 |
| AU-rich seed (APP) | AD-507789.2 | gsusgguuUfgUfGfAfcccaauuaauL96 | 2773 | asUfsuaaUfuGfGfgucaCfaAfaccacsasa | 2774 | UUGUGGUUUGUGACCCAAUUAAG | 2775 |
| AU-rich seed (APP) | AD-507874.2 | csasgaugCfuUfUfAfgagagauuuuL96 | 2776 | asAfsaauCfuCfUfcuaaAfgCfaucugsasa | 2777 | UUCAGAUGCUUUAGAGAGAUUUU | 2778 |
| AU-rich seed (APP) | AD-507928.2 | uscsuugcCfuAfAfGfuauuccuuuuL96 | 2779 | asAfsaagGfaAfUfacuuAfgGfcaagasgsa | 2780 | UCUCUUGCCUAAGUAUUCCUUUC | 2781 |
| AU-rich seed (APP) | AD-507949.2 | ususgcugCfuUTCfUfgcuauauuuuL96 | 2782 | asAfsaauAfuAfGfcagaAfgCfagcaasusc | 2783 | GAUUGCUGCUUCUGCUAUAUUUG | 2784 |

Table 20 key:
U = uridine-3'-phosphate,
u = 2'-O-methyluridine-3'-phosphate,
us = 2'-O-methyluridine-3'-phosphorothioate,
a = 2'-O-methyladenosine-3'-phosphate,
A = adenosine-3'-phosphate,
as = 2'-O-methyladenosine-3'-phosphorothioate,
(Ahd) = 2'-O-hexadecyl-adenosine-3'-phosphate,
Gf = 2'-fluoroguanosine-3'-phosphate,
Uf = 2'-fluorouridine-3'-phosphate,
Cf = 2'-fluorocytidine-3'-phosphate,
Af = 2'-fluoroadenosine-3'-phosphate,
cs = 2'-O-methylcytidine-3'-phosphate ,
VP = Vinylphosphate 5',
(Agn) = Adenosine-glycol nucleic acid (GNA),
gs = 2'-O-methylguanosine-3'-phosphorothioate,
(Chd) = 2'-O-hexadecyl-cytidine-3'-phosphate,
(Tgn) = Thymidine-glycol nucleic acid (GNA) S-Isomer,
(Ghd) = 2'-O-hexadecyl-guanosine-3'-phosphate,
and
cs = 2'-O-methylcytidine-3'-phosphorothioate.

Selected AU-rich candidates were evaluated for in vivo efficacy in lead identification screens for human APP knockdown in AAV mice. Briefly, an AAV vector harboring *Homo sapiens* APP (e.g., hsAPP-CDS3TRNC) was intravenously injected into 6-8 week old C57BL/6 female mice, and at 14 days post-AAV administration a selected RNAi agent or a control agent was subcutaneously injected into the mice (n=3 per group at a dose of 3 mg/kg. The screening groups are summarized in Table 21.

TABLE 21

Screening Groups for AU-rich Candidates in AAV Mice.

| siRNA Date | Group # | Animal # | Treatment | Dose | Timepoint |
|---|---|---|---|---|---|
| 8 Mar. 2019 | 1 | 1 | PBS | N/A | D 14 |
| 8 Mar. 2019 | 1 | 2 | PBS | N/A | D 14 |
| 8 Mar. 2019 | 1 | 3 | PBS | N/A | D 14 |
| 8 Mar. 2019 | 1 | 4 | PBS | N/A | D 14 |
| 8 Mar. 2019 | 1 | 5 | PBS | N/A | D 14 |
| 8 Mar. 2019 | 2 | 6 | Naïve | N/A | D 14 |
| 8 Mar. 2019 | 2 | 7 | Naïve | N/A | D 14 |
| 8 Mar. 2019 | 2 | 8 | Naïve | N/A | D 14 |
| 8 Mar. 2019 | 2 | 9 | Naïve | N/A | D 14 |
| 8 Mar. 2019 | 3 | 10 | AD-392927.2 (from RLD592) | 3 mg/kg | D 14 |
| 8 Mar. 2019 | 3 | 11 | AD-392927.2 (from RLD592) | 3 mg/kg | D 14 |
| 8 Mar. 2019 | 3 | 12 | AD-392927.2 (from RLD592) | 3 mg/kg | D 14 |
| 8 Mar. 2019 | 4 | 13 | AD-506935.2 | 3 mg/kg | D 14 |
| 8 Mar. 2019 | 4 | 14 | AD-506935.2 | 3 mg/kg | D 14 |
| 8 Mar. 2019 | 4 | 15 | AD-506935.2 | 3 mg/kg | D 14 |
| 8 Mar. 2019 | 5 | 16 | AD-507065.2 | 3 mg/kg | D 14 |
| 8 Mar. 2019 | 5 | 17 | AD-507065.2 | 3 mg/kg | D 14 |
| 8 Mar. 2019 | 5 | 18 | AD-507065.2 | 3 mg/kg | D 14 |
| 8 Mar. 2019 | 6 | 19 | AD-507159.2 | 3 mg/kg | D 14 |
| 8 Mar. 2019 | 6 | 20 | AD-507159.2 | 3 mg/kg | D 14 |
| 8 Mar. 2019 | 6 | 21 | AD-507159.2 | 3 mg/kg | D 14 |
| 8 Mar. 2019 | 7 | 22 | AD-507538.2 | 3 mg/kg | D 14 |
| 8 Mar. 2019 | 7 | 23 | AD-507538.2 | 3 mg/kg | D 14 |
| 8 Mar. 2019 | 7 | 24 | AD-507538.2 | 3 mg/kg | D 14 |
| 8 Mar. 2019 | 8 | 25 | AD-507624.2 | 3 mg/kg | D 14 |
| 8 Mar. 2019 | 8 | 26 | AD-507624.2 | 3 mg/kg | D 14 |
| 8 Mar. 2019 | 8 | 27 | AD-507624.2 | 3 mg/kg | D 14 |
| 8 Mar. 2019 | 9 | 28 | AD-507724.2 | 3 mg/kg | D 14 |
| 8 Mar. 2019 | 9 | 29 | AD-507724.2 | 3 mg/kg | D 14 |
| 8 Mar. 2019 | 9 | 30 | AD-507724.2 | 3 mg/kg | D 14 |
| 8 Mar. 2019 | 10 | 31 | AD-507725.2 | 3 mg/kg | D 14 |
| 8 Mar. 2019 | 10 | 32 | AD-507725.2 | 3 mg/kg | D 14 |
| 8 Mar. 2019 | 10 | 33 | AD-507725.2 | 3 mg/kg | D 14 |
| 8 Mar. 2019 | 11 | 34 | AD-507789.2 | 3 mg/kg | D 14 |
| 8 Mar. 2019 | 11 | 35 | AD-507789.2 | 3 mg/kg | D 14 |
| 8 Mar. 2019 | 11 | 36 | AD-507789.2 | 3 mg/kg | D 14 |
| 8 Mar. 2019 | 12 | 37 | AD-507874.2 | 3 mg/kg | D 14 |
| 8 Mar. 2019 | 12 | 38 | AD-507874.2 | 3 mg/kg | D 14 |
| 8 Mar. 2019 | 12 | 39 | AD-507874.2 | 3 mg/kg | D 14 |
| 8 Mar. 2019 | 13 | 40 | AD-507928.2 | 3 mg/kg | D 14 |
| 8 Mar. 2019 | 13 | 41 | AD-507928.2 | 3 mg/kg | D 14 |
| 8 Mar. 2019 | 13 | 42 | AD-507928.2 | 3 mg/kg | D 14 |
| 8 Mar. 2019 | 14 | 43 | AD-507949.2 | 3 mg/kg | D 14 |
| 8 Mar. 2019 | 14 | 44 | AD-507949.2 | 3 mg/kg | D 14 |
| 8 Mar. 2019 | 14 | 45 | AD-507949.2 | 3 mg/kg | D 14 |

Figure 15:
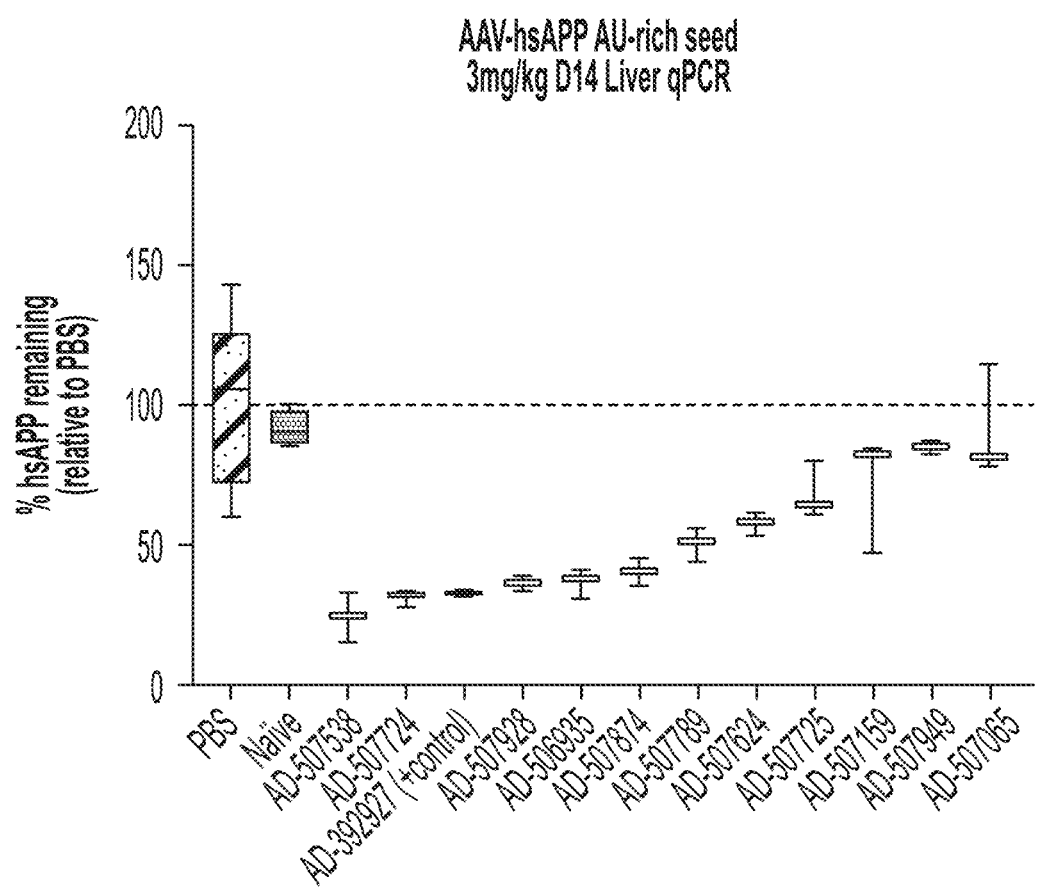
FIG. 15 is a graph depicting % hs APP knockdown in the liver of AAV8.HsAPP-CDS3TRNC mice treated with AU-rich seeds. PBS, Naïve, and AD-392927 (RLD592) controls are included in the graph.
Figure 16A:
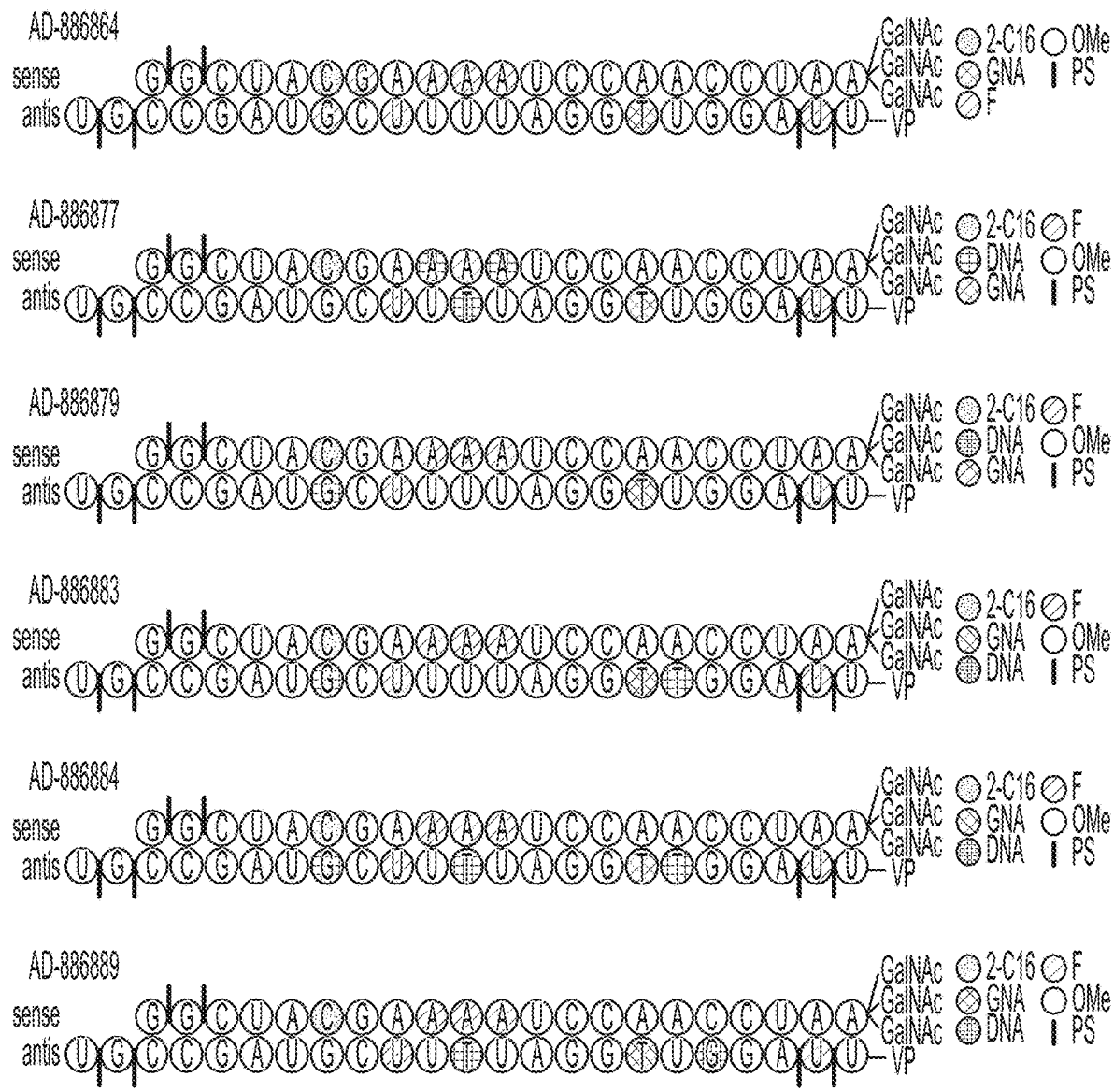
FIG. 16A-16D are schematic images of modified lead RNAi agents that were screened for in vivo hsAPP knockdown activity in AAV mice. The agents include AD-886864 (sense strand SEQ ID NO:2598, antisense strand SEQ ID NO:2599), AD-886877 (sense strand SEQ ID NO:2624, antisense strand SEQ ID NO:2625), AD-886879 (sense strand SEQ ID NO:2628, antisense strand SEQ ID NO:2629), AD-886883 (sense strand SEQ ID NO:2636, antisense strand SEQ ID NO:2637), AD-886884 (sense strand SEQ ID NO:2638, antisense strand SEQ ID NO:2639), AD-886889 (sense strand SEQ ID NO:2648, antisense strand SEQ ID NO:2649), AD-886899 (sense strand SEQ ID NO:2668, antisense strand SEQ ID NO:2669), AD-886900 (sense strand SEQ ID NO:2670, antisense strand SEQ ID NO:2671), AD-886907 (sense strand SEQ ID NO:2684, antisense strand SEQ ID NO:2685), AD-886908 (sense strand SEQ ID NO:2686, antisense strand SEQ ID NO:2687), AD-886919 (sense strand SEQ ID NO:2708, antisense strand SEQ ID NO:2709), AD-886930 (sense strand SEQ ID NO:2730, antisense strand SEQ ID NO:2731), AD-886931 (sense strand SEQ ID NO:2732, antisense strand SEQ ID NO:2733), AD-886823 (sense strand SEQ ID NO:2516, antisense strand SEQ ID NO:2517), AD-886853 (sense strand SEQ ID NO:2576, antisense strand SEQ ID NO:2577), AD-886858 (sense strand SEQ ID NO:2586, antisense strand SEQ ID NO:2587), AD-886839 (sense strand SEQ ID NO:2546, antisense strand SEQ ID NO:2547), AD-886845 (sense strand SEQ ID NO:2560, antisense strand SEQ ID NO:2561), AD-886873 (sense strand SEQ ID NO:2616, antisense strand SEQ ID NO:2617), AD-886906 (sense strand SEQ ID NO:2682, antisense strand SEQ ID NO:2683), AD-886909 (sense strand SEQ ID NO:2688, antisense strand SEQ ID NO:2689), and AD-886928 (sense strand SEQ ID NO:2726, antisense strand SEQ ID NO:2727).
Figure 16B:
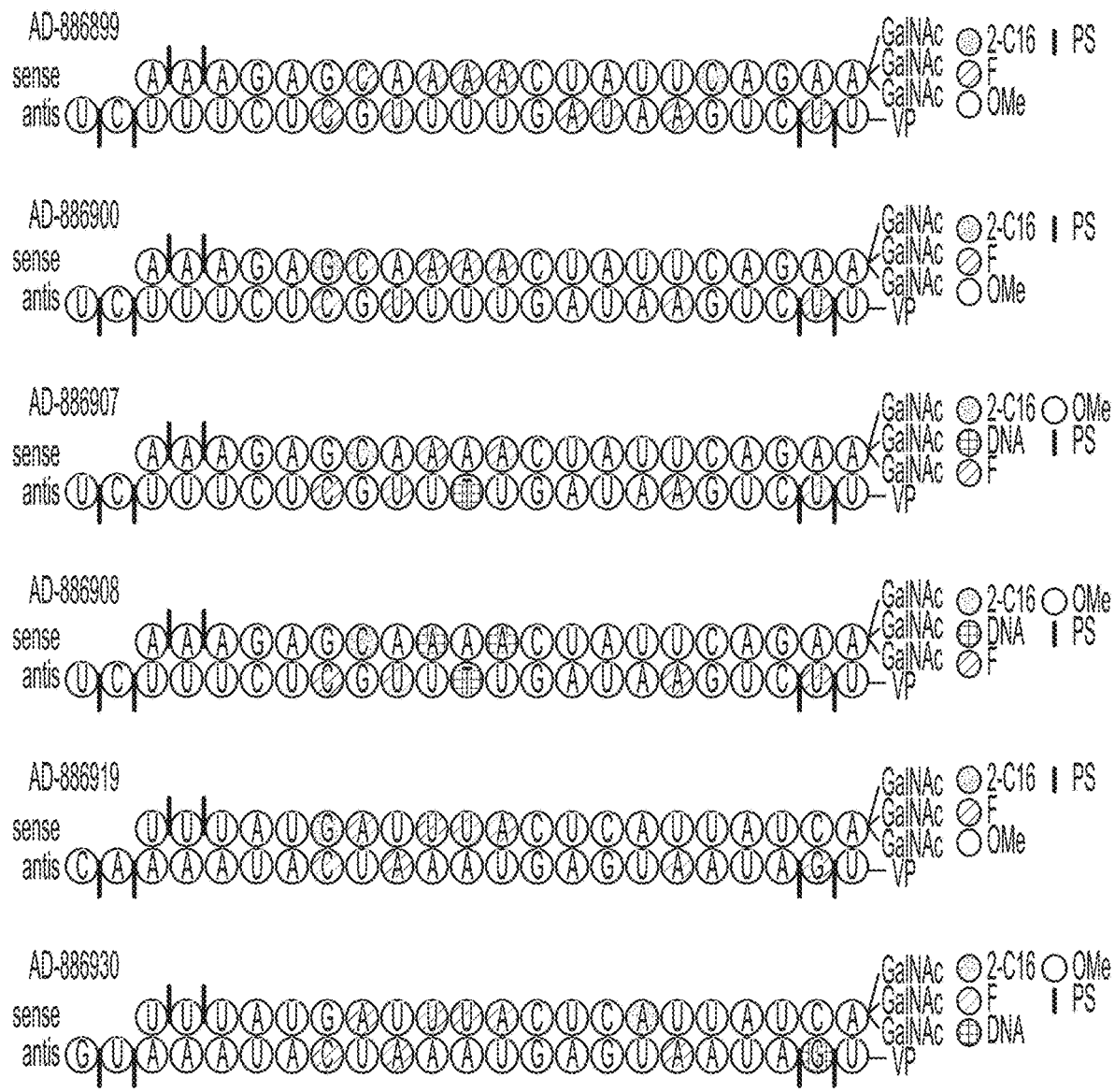
Figure 16C:
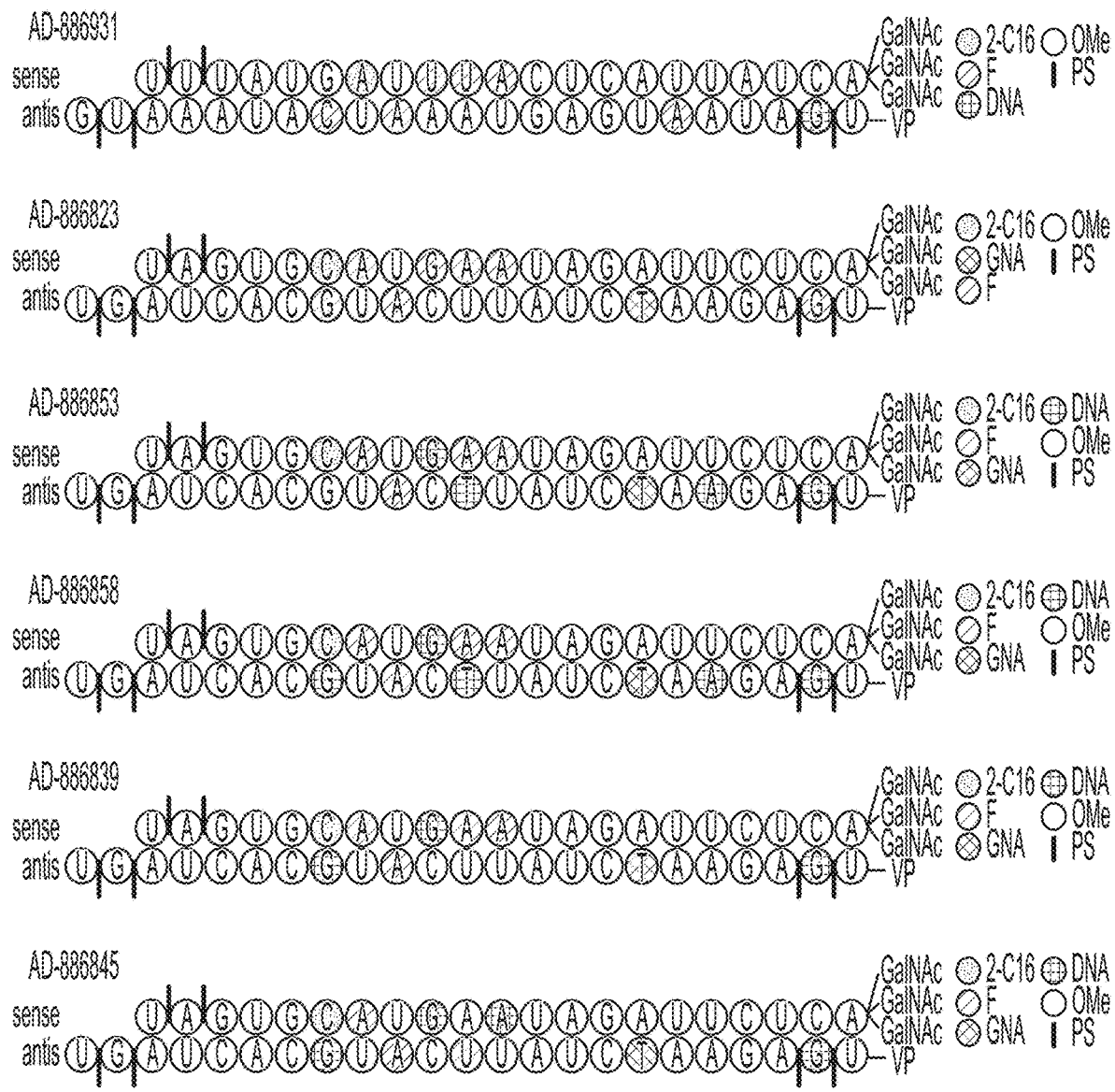
Figure 16D:
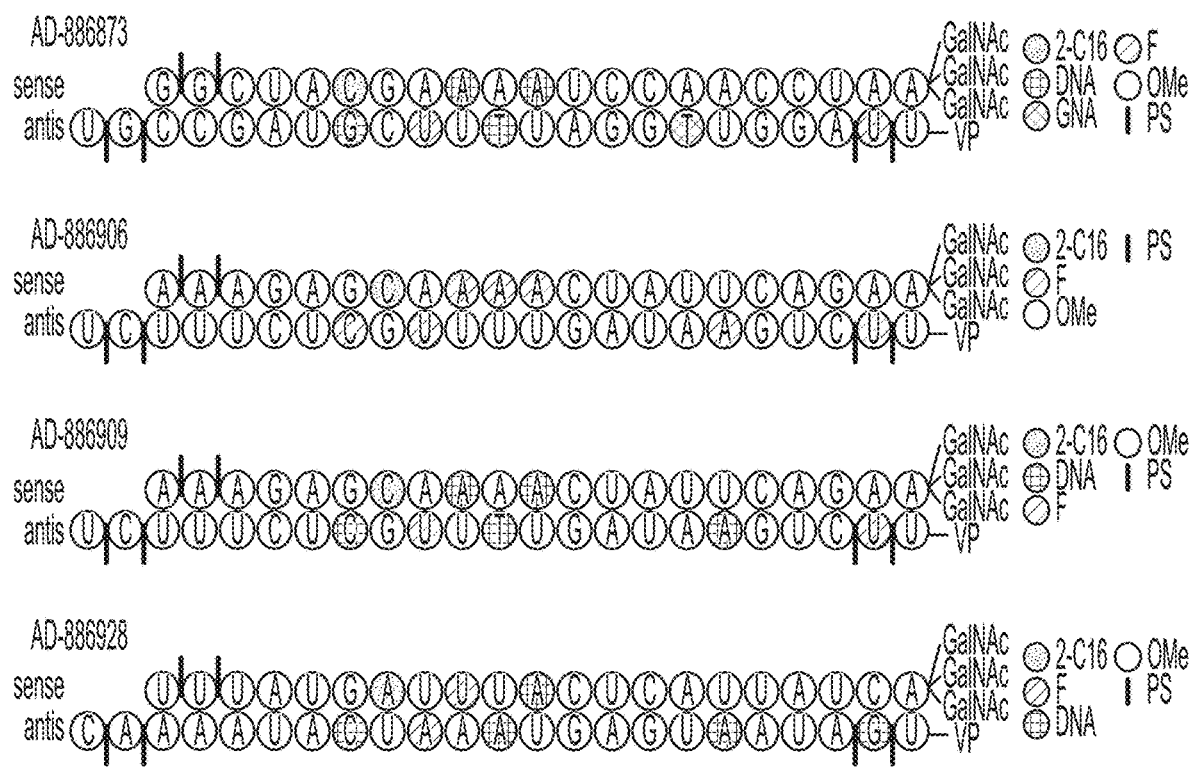

The mice were sacrificed and their livers were assessed for APP mRNA levels at 14 days post-subcutaneous injection of RNAi agent or control by qPCR. As shown in Table 22 and FIG. 15, significant levels of in vivo human APP mRNA knockdown in liver were observed for most AU-rich RNAi agents tested, as compared to PBS and Naïve (AAV only) controls, with particularly robust levels of knockdown observed for AD-507538.2, AD-507724.2, AD-392927.2 (RLD592), AD-507928.2, AD-506935.2, and AD-507874.2

TABLE 22

Summary of Screening Results for AU-rich Candidates in AAV Mice.
hsAPP AU rich seed
3 mg/kg liver qPCR D 14
% hsAPP message remaining relative to PBS

| Treatment | Group Average | Standard Deviation |
|---|---|---|
| PBS | 100.00 | 30.90 |
| Naïve | 91.48 | 6.43 |
| AD-507538.2 | 24.23 | 8.73 |
| AD-507724.2 | 30.90 | 2.95 |
| AD-392927.2 (RLD592) | 32.80 | 0.92 |
| AD-507928.2 | 36.31 | 2.61 |
| AD-506935.2 | 36.47 | 5.26 |
| AD-507874.2 | 40.43 | 4.99 |
| AD-507789.2 | 50.24 | 6.06 |
| AD-507624.2 | 57.67 | 4.22 |
| AD-507725.2 | 68.53 | 10.04 |
| AD-507159.2 | 71.49 | 20.82 |
| AD-507949.2 | 84.94 | 2.35 |
| AD-507065.2 | 91.09 | 20.17 |

Table 23 shows a comparison of in vivo human hsAPP mRNA knockdown in liver by the above-described AU-rich RNAi agents at 3 mg/kg as compared to in vitro APP knockdown of the same AU-rich RNAi agents at either 10 nM or 0.1 nM in both DL and Be(2)C cell lines.

TABLE 23

Comparison of In Vivo vs. In Vitro hsAPP Knockdown.

| hsAPP % remaining | RLD 701 In vivo 3 mg/kg | | RLD 646 (in vitro) | | | | | | | |
|---|---|---|---|---|---|---|---|---|---|---|
| | | | DL (dual-Luc) | | | | Be(2)C (human neuron) | | | |
| | | | Dose -- 10 nM | Unit 10 nM | Dose -- 0.1 nM | Unit 0.1 nM | Dose -- 10 nM | Unit 10 nM | Dose -- 0.1 nM | Unit 0.1 nM |
| Duplex | Avg | SD | Avg | SD | Avg | SD | Avg | SD | Avg | SD |
| AD-507538 | 24.2 | 8.7 | 22.5 | 5.5 | 106.2 | 45.3 | 16.6 | 3.8 | 23.3 | 2.5 |
| AD-507724 | 30.9 | 2.9 | 38.5 | 9.2 | 119.8 | 24.6 | 21.2 | 1.9 | 43.5 | 9.6 |
| AD-507928 | 36.3 | 2.6 | 10.6 | 1.8 | 101.1 | 23.8 | 25.1 | 2.7 | 39.8 | 22.1 |
| AD-506935 | 36.5 | 5.3 | 37.4 | 10.1 | 75.9 | 18.4 | 19.7 | 3.9 | 22.3 | 2.2 |
| AD-507874 | 40.4 | 5.0 | 13.6 | 10.9 | 105.7 | 29.1 | 21.9 | 2.4 | 31.3 | 13.1 |
| AD-507789 | 50.2 | 6.1 | 34.3 | 12.0 | 121.2 | 30.9 | 24.0 | 6.0 | 38.3 | 3.6 |
| AD-507624 | 57.7 | 4.2 | 32.7 | 7.0 | 116.5 | 28.6 | 22.1 | 1.0 | 68.0 | 26.2 |
| AD-507725 | 68.5 | 10.0 | 68.6 | 13.1 | 107.8 | 43.5 | 31.1 | 5.4 | 34.1 | 9.7 |
| AD-507159 | 71.5 | 20.8 | 56.8 | 20.2 | 119.7 | 42.4 | 26.2 | 4.6 | 42.7 | 8.6 |
| AD-507949 | 84.9 | 2.3 | 57.1 | 25.6 | 99.7 | 29.8 | 23.3 | 3.1 | 42.9 | 15.2 |
| AD-507065 | 91.1 | 20.2 | 52.5 | 11.6 | 106.1 | 19.2 | 25.3 | 7.2 | 39.4 | 5.8 |

Example 7. In Vivo APP Screening of Lead Sequences for Structure Activity Relationship Studies In vivo screening was performed on C57BL/6 mice to conduct structure activity relationship studies on lead oligonucleotides. A summary of the study design is presented in Table 24. As shown in Table 25, the following lead oligonucleotides were tested: AD-886823, AD-886839, AD-886845, AD-886853, AD-886858, AD-886864, AD-886873, AD-886877, AD-886879, AD-886883, AD-886884, AD-886889, AD-886899, AD-886900, AD-886906, AD-886907, AD-886908, AD-886909, AD-886919, AD-886928, AD-886930 and AD-886931. Table 25 lists sense and antisense sequences for each lead oligonucleotide, as well as the associated target sequence for each lead oligonucleotide. The structures of the lead oligonucleotides are shown in FIG. 16A, FIG. 16B, FIG. 16C, and FIG. 16D.

TABLE 24

Study Design

| | | |
|---|---|---|
| AAV | Name | AAV8.HsAPP-CDS3TRNC VCAV-04731 |
| | Dose | 2E+11 |
| | Injection method | IV (retro orbital) |
| siRNA | Injection method | Subcutaneous |
| | Dose | 3 mg/kg |
| | Sample | Liver |
| | Collection days | D 14 |
| Animals | Sex | Female |
| | Strain | C57BL/6 |
| | Age (on arrival) | 6-8 weeks |
| | Vendor | Jackson Lab |
| | Duplex No. | 16 |
| | n= | 3 |
| | Total animals | 72 |
| Analysis | Analysis method | RT-qPCR |
| | Taqman probe | Mouse GAPDH Applied Biosystems 4351309 APP: Hs00169098_m1 (FAM) |

TABLE 25 hsAPP Duplex and Target Sequences for SAR Lead Candidates.

| Duplex | Strand | Oligonucleotide Sequence | SEQ ID NO: | Target Sequence | SEQ ID NO: |
|---|---|---|---|---|---|
| AD-886823.2 | Sense (5' to 3') | usasgug(Chd)AfuGfAfAfuag auucucaL96 | 2785 | UAGUGCAUGAAUAGAUUCUCA | 2829 |
| | Antisense (5' to 3') | VPusGfsagaa(Tgn)cuauucAf uGfcacuasgsu | 2786 | UGAGAAUCUAUUCAUGCACUAGU | 2830 |
| AD-886839.2 | Sense (5' to 3') | usasgug(Chd)AfudGAfAfuag auucucaL96 | 2787 | UAGUGCAUGAAUAGAUUCUCA | 2831 |
| | Antisense (5' to 3') | VPusdGsagaa(Tgn)cuauucAf udGcacuasgsu | 2788 | UGAGAAUCUAUUCAUGCACUAGU | 2832 |
| AD-886845.2 | Sense (5' to 3') | usasgug(Chd)audGadAuagau ucucaL96 | 2789 | UAGUGCAUGAAUAGAUUCUCA | 2833 |
| | Antisense (5' to 3') | VPudGagaa(Tgn)cuauUfcAfu dGcacuasgsu | 2790 | UGAGAAUCUAUUCAUGCACUAGU | 2834 |
| AD-886853.2 | Sense (5' to 3') | usasgug(Chd)AfudGAfAfuag auucucaL96 | 2791 | UAGUGCAUGAAUAGAUUCUCA | 2835 |
| | Antisense (5' to 3') | VPusdGsagdAa(Tgn)cuaudTc Afugcacuasgsu | 2792 | UGAGAAUCUAUUCAUGCACUAGU | 2836 |
| AD-886858.2 | Sense (5' to 3') | usasgug(Chd)AfudGAfAfuag auucucaL96 | 2793 | UAGUGCAUGAAUAGAUUCUCA | 2837 |
| | Antisense (5' to 3') | VPudGagdAa(Tgn)cuaudTcAf udGcacuasgsu | 2794 | UGAGAAUCUAUUCAUGCACUAGU | 2838 |
| AD-886864.2 | Sense (5' to 3') | gsgscua(Chd)GfaAfAfAfucc aaccuaaL96 | 2795 | GGCUACGAAAAUCCAACCUAA | 2839 |
| | Antisense (5' to 3') | VPusUfsaggu(Tgn)ggauuuUf cGfuagccsgsu | 2796 | UUAGGUTGGAUUUUCGUAGCCGU | 2840 |
| AD-886873.2 | Sense (5' to 3') | gsgscua(Chd)gadAadAuccaa ccuaaT96 | 2797 | GGCUACGAAAAUCCAACCUAA | 2841 |
| | Antisense (5' to 3') | VPusUfsaggu(Tgn)ggandTnU fcdGuagccsgsn | 2798 | UUAGGUTGGAUUUUCGUAGCCGU | 2842 |
| AD-886877.2 | Sense (5' to 3') | gsgscua(Chd)gadAadAuccaa ccuanT96 | 2799 | GGCUACGAAAAUCCAACCUAA | 2843 |
| | Antisense (5' to 3') | VPusUfsaggu(Tgn)ggandTnU fcguagccsgsn | 2800 | UUAGGUTGGAUUUUCGUAGCCGU | 2844 |

TABLE 25-continued hsAPP Duplex and Target Sequences for SAR Lead Candidates.

| Duplex | Strand | Oligonucleotide Sequence | SEQ ID NO: | Target Sequence | SEQ ID NO: |
|---|---|---|---|---|---|
| AD-886879.2 | Sense (5' to 3') | gsgscua(Chd)gaAfAfAfuccaaccuaaL96 | 2801 | GGCUACGAAAAUCCAACCUAA | 2845 |
| | Antisense (5' to 3') | VPusUfsaggu(Tgn)gganunUfcdGuagccsgsn | 2802 | UUAGGUTGGAUUUUCGUAGCCGU | 2846 |
| AD-886883.2 | Sense (5' to 3') | gsgscua(Chd)gaAfAfAfuccaaccuaaL96 | 2803 | GGCUACGAAAAUCCAACCUAA | 2847 |
| | Antisense (5' to 3') | VPuUfaggdT(Tgn)gganunUfcdGuagccsgsn | 2804 | UUAGGTTGGAUUUUCGUAGCCGU | 2848 |
| AD-886884.2 | Sense (5' to 3') | gsgscua(Chd)gaAfAfAfuccaaccuaaL96 | 2805 | GGCUACGAAAAUCCAACCUAA | 2849 |
| | Antisense (5' to 3') | VPuUfaggdT(Tgn)ggandTnUfcdGuagccsgsn | 2806 | UUAGGUTGGAUUUUCGUAGCCGU | 2850 |
| AD-886889.2 | Sense (5' to 3') | gsgscua(Chd)gaAfAfAfuccaaccuaaL96 | 2807 | GGCUACGAAAAUCCAACCUAA | 2851 |
| | Antisense (5' to 3') | VPuUfagdGn(Tgn)ggandTuUfcguagccsgsn | 2808 | UUAGGUTGGAUUUUCGUAGCCGU | 2852 |
| AD-886899.2 | Sense (5' to 3') | asasagagCfaAfAfAfcuann(Chd)aganT96 | 2809 | AAAGAGCAAAACUAUUCAGAA | 2853 |
| | Antisense (5' to 3') | VPusUfscugAfaUfAfgunnUfgCfncuunscsu | 2810 | UUCUGAAUAGUUUUGCUCUUUCU | 2854 |
| AD-886900.2 | Sense (5' to 3') | asasaga(Ghd)CfaAfAfAfcuanucaganT96 | 2811 | AAAGAGCAAAACUAUUCAGAA | 2855 |
| | Antisense (5' to 3') | VPusUfscugAfauaguuuUfgCfucuuuscsu | 2812 | UUCUGAAUAGUUUUGCUCUUUCU | 2856 |
| AD-886906.2 | Sense (5' to 3') | asasagag(Chd)aAfAfAfcuauucagaaL96 | 2813 | AAAGAGCAAAACUAUUCAGAA | 2857 |
| | Antisense (5' to 3') | VPuUfcugAfauaguunUfgCfucuuuscsu | 2814 | UUCUGAAUAGUUUUGCUCUUUCU | 2858 |
| AD-886907.2 | Sense (5' to 3') | asasagag(Chd)aAfaAfcuauucagaaL96 | 2815 | AAAGAGCAAAACUAUUCAGAA | 2859 |
| | Antisense (5' to 3') | VPuUfcugAfauagudTuUfgCfucuuuscsu | 2816 | UUCUGAAUAGUTUUGCUCUUUCU | 2860 |
| AD-886908.2 | Sense (5' to 3') | asasagag(Chd)adAadAcuauucagapT96 | 2817 | AAAGAGCAAAACUAUUCAGAA | 2861 |
| | Antisense (5' to 3') | VPuUfcugAfauagudTuUfgCfucuuuscsu | 2818 | UUCUGAAUAGUUUUGCUCUUUCU | 2862 |
| AD-886909.2 | Sense (5' to 3') | asasagag(Chd)adAadAcuauucagapT96 | 2819 | AAAGAGCAAAACUAUUCAGAA | 2863 |
| | Antisense (5' to 3') | VPuUfcugdAauagudTuUfgdCucuuuscsu | 2820 | UUCUGAAUAGUUUUGCUCUUUCU | 2864 |
| AD-886919.2 | Sense (5' to 3') | ususuau(Ghd)AftfUTUfAfcucauuaucaL96 | 2821 | UUUAUGAUUUACUCAUUAUCA | 2865 |
| | Antisense (5' to 3') | VPusGfsauaAfugaguaaAfuCfauaaasasc | 2822 | UGAUAAUGAGUAAAUCAUAAAAC | 2866 |
| AD-886928.2 | Sense (5' to 3') | ususuaug(Ahd)uUfudAcucauuaucaL96 | 2823 | UUUAUGAUUUACUCAUUAUCA | 2867 |
| | Antisense (5' to 3') | VPudGauadAugagudAaAfudCauaaasasc | 2824 | UGAUAAUGAGUAAAUCAUAAAAC | 2868 |
| AD-886930.2 | Sense (5' to 3') | ususuaugAfuUTUfAfcuc(Ahd)uuaucaL96 | 2825 | UUUAUGAUUUACUCAUUAUCA | 2869 |
| | Antisense (5' to 3') | VPusdGsauaAfugaguaaAfuCfauaaasusg | 2826 | UGAUAAUGAGUAAAUCAUAAAUG | 2870 |

TABLE 25-continued hsAPP Duplex and Target Sequences for SAR Lead Candidates.

| Duplex | Strand | Oligonucleotide Sequence | SEQ ID NO: | Target Sequence | SEQ ID NO: |
|---|---|---|---|---|---|
| AD-886931.2 | Sense (5' to 3') | ususuaug(Ahd)uUfUfAfcucau uaucaL96 | 2827 | UUUAUGAUUUACUCAUUAUCA | 2871 |
| | Antisense (5' to 3') | VPusdGsanaAfugaguaaAfuCfa uaaasusg | 2828 | UGAUAAUGAGUAAAUCAUAAAUG | 2872 |

```
Table 25 key:
U = uridine-3-phosphate,
u = 2'-O-methyluridine-3'-phosphate,
us = 2'-O-methyluridine-3'-phosphorothioate,
a = 2'-O-methyladenosine-3'-phosphate,
A = adenosine-3'-phosphate,
as = 2'-O-methyladenosine-3'-phosphorothioate,
(Ahd) = 2'-O-hexadecyl-adenosine-3'-phosphate,
Gf = 2'-fluoroguanosine-3'-phosphate,
Uf = 2'-fluorouridine-3'-phosphate,
Cf = 2'-fluorocytidine-3'-phosphate,
Af = 2'-fluoroadenosine-3'-phosphate,
cs = 2'-O-methylcytidine-3'-phosphate,
VP = Vinylphosphate 5',
(Agn) = Adenosine-glycol nucleic acid (GNA),
gs = 2'-O-methylguanosine-3'-phosphorothioate,
(Chd) = 2'-O-hexadecyl-cytidine-3'-phosphate,
(Tgn) = Thymidine-glycol nucleic acid (GNA) S-Isomer,
(Ghd) = 21-O-hexadecyl-guanosine-3'-phosphate,
and
cs = 2'-O-methylcytidine-3'-phosphorothioate.
```

Selected candidates were evaluated for in vivo efficacy in screens for human APP knockdown in AAV mice.

Briefly, an AAV vector harboring Homo sapiens APP (e.g., AAV8.HsAPP-CDS3TRNC) was intravenously injected into 6-8 week old C57BL/6 female mice, and at 14 days post-AAV administration a selected RNAi agent or a control agent was subcutaneously injected into the mice (n/per group) at a dose of 3 mg/kg.

The mice were sacrificed and their livers were assessed for APP mRNA levels at 14 days post-subcutaneous injection of RNAi agent or control by qPCR.

Figure 17A:
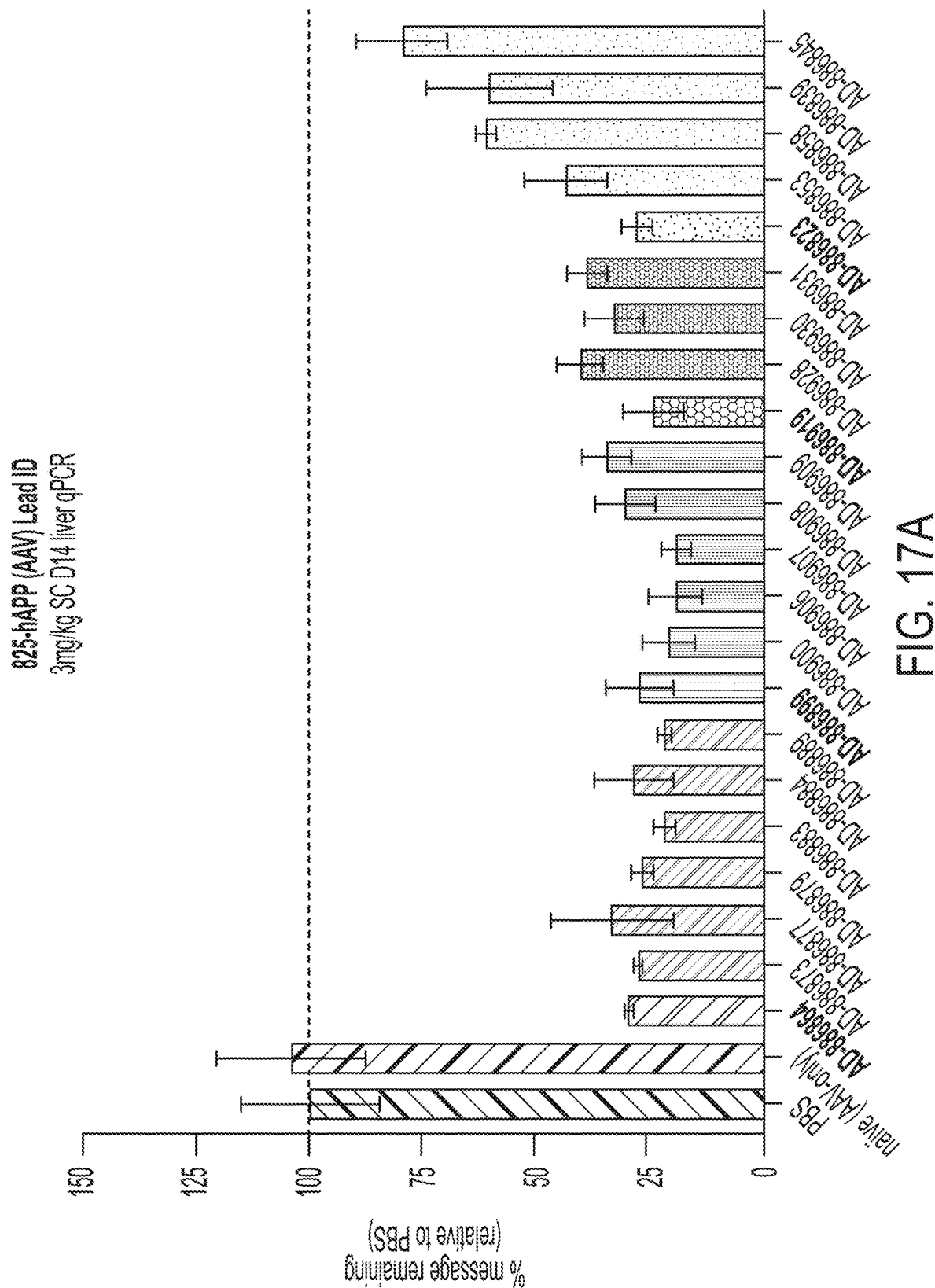
FIG. 17A and FIG. 17B are graphs depicting % hs APP knockdown in the liver of AAV8.HsAPP-CDS3TRNC mice treated with lead oligonucleotides. PBS and Naïve, controls are included in the graphs.
Figure 17B:
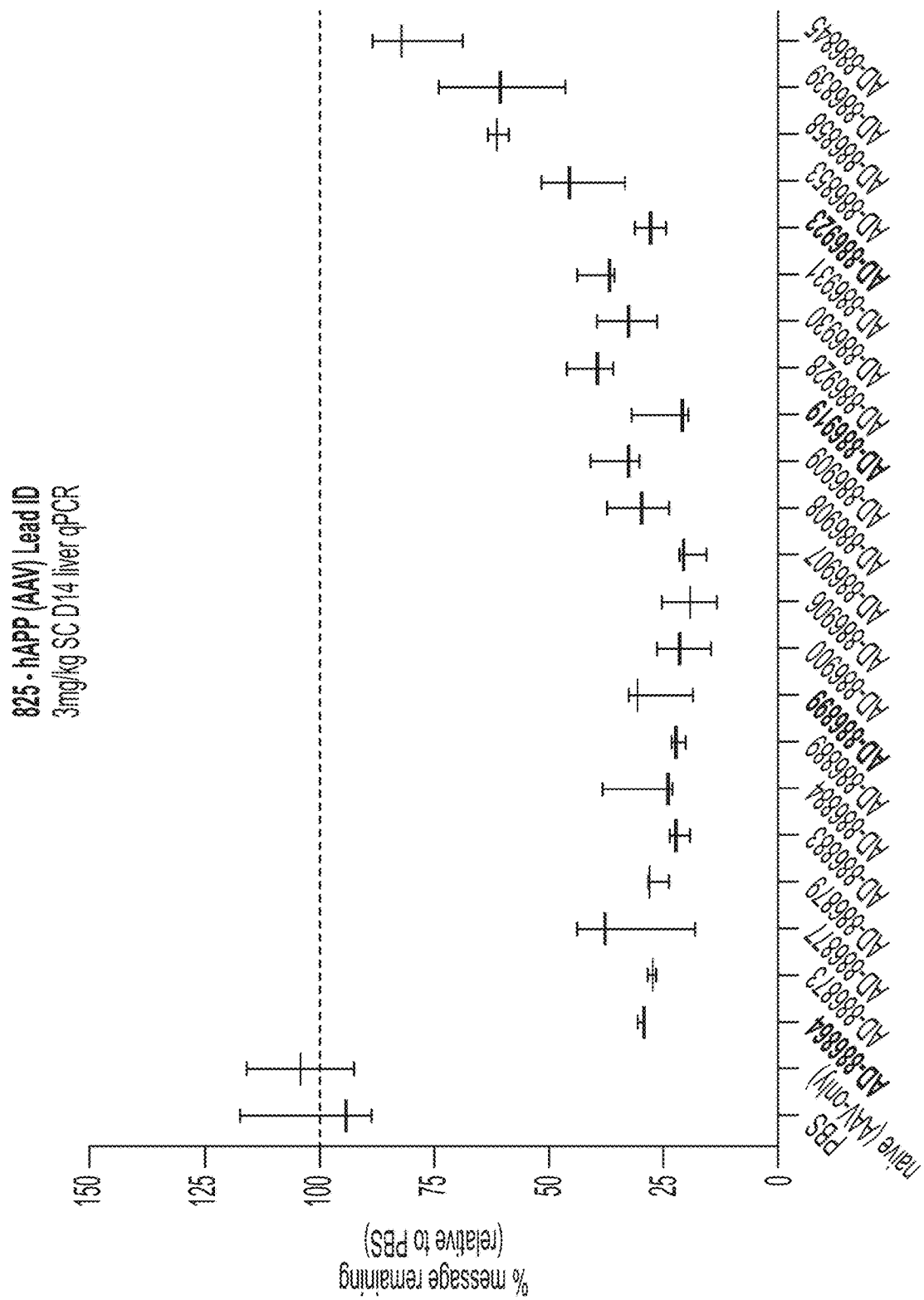
Figure 18A:
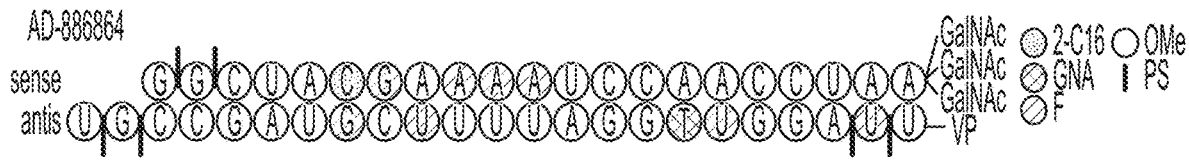
FIGS. 18A-18D are schematic images of modified lead RNAi agents that were screened for in vivo hsAPP knockdown activity in AAV mice and which are grouped as families based on the AD-886864 parent (FIG. 18A), AD-886899 parent (FIG. 18B), AD-886919 parent (FIG. 18C), and AD-886823 parent (FIG. 18D), respectively. The screened agents include AD-886864 (sense strand SEQ ID NO:2598, antisense strand SEQ ID NO:2599), AD-886873 (sense strand SEQ ID NO:2616, antisense strand SEQ ID NO:2617), AD-886877 (sense strand SEQ ID NO:2624, antisense strand SEQ ID NO:2625), AD-886879 (sense strand SEQ ID NO:2628, antisense strand SEQ ID NO:2629), AD-886883 (sense strand SEQ ID NO:2636, antisense strand SEQ ID NO:2637), AD-886884 (sense strand SEQ ID NO:2638, antisense strand SEQ ID NO:2639), AD-886889 (sense strand SEQ ID NO:2648, antisense strand SEQ ID NO:2649), AD-886899 (sense strand SEQ ID NO:2668, antisense strand SEQ ID NO:2669), AD-886900 (sense strand SEQ ID NO:2670, antisense strand SEQ ID NO:2671), AD-886906 (sense strand SEQ ID NO:2682, antisense strand SEQ ID NO:2683), AD-886907 (sense strand SEQ ID NO:2684, antisense strand SEQ ID NO:2685), AD-886908 (sense strand SEQ ID NO:2686, antisense strand SEQ ID NO:2687), AD-886909 (sense strand SEQ ID NO:2688, antisense strand SEQ ID NO:2689), AD-886919 (sense strand SEQ ID NO:2708, antisense strand SEQ ID NO:2709), AD-886928 (sense strand SEQ ID NO:2726, antisense strand SEQ ID NO:2727), AD-886930 (sense strand SEQ ID NO:2730, antisense strand SEQ ID NO:2731), AD-886931 (sense strand SEQ ID NO:2732, antisense strand SEQ ID NO:2733), AD-886823 (sense strand SEQ ID NO:2516, antisense strand SEQ ID NO:2517), AD-886853 (sense strand SEQ ID NO:2576, antisense strand SEQ ID NO:2577), AD-886858 (sense strand SEQ ID NO:2586, antisense strand SEQ ID NO:2587), AD-886839 (sense strand SEQ ID NO:2546, antisense strand SEQ ID NO:2547), and AD-88845 (sense strand SEQ ID NO:2560; antisense strand SEQ ID NO:2561).
Figure 18A:
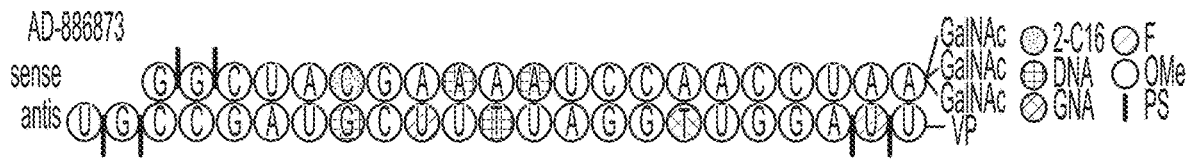
Figure 18A:
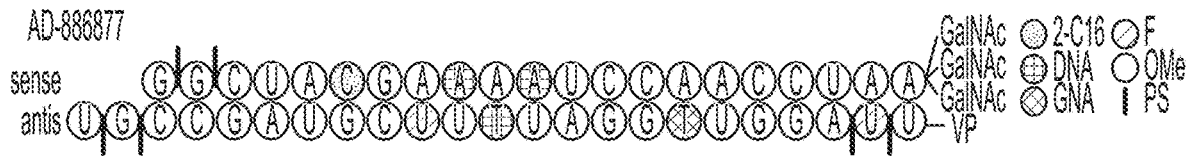
Figure 18A:
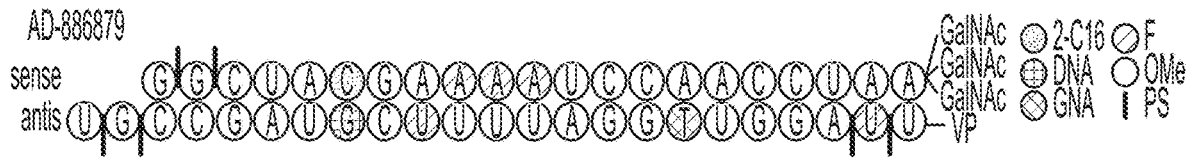
Figure 18A:
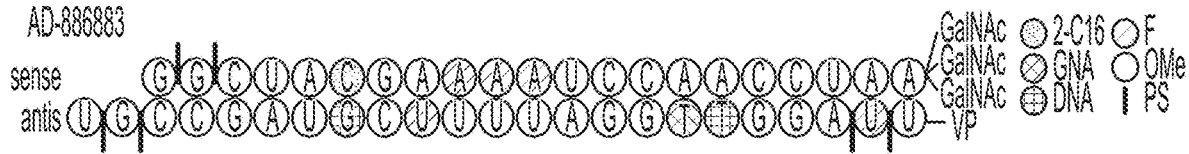
Figure 18A:
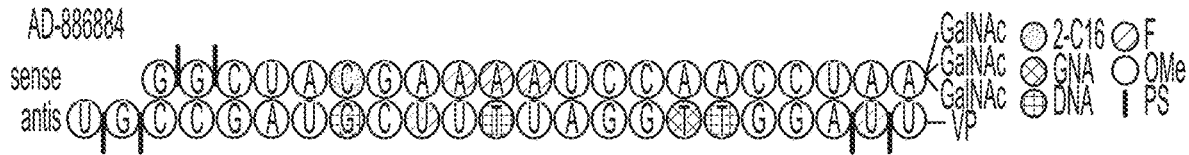
Figure 18A:
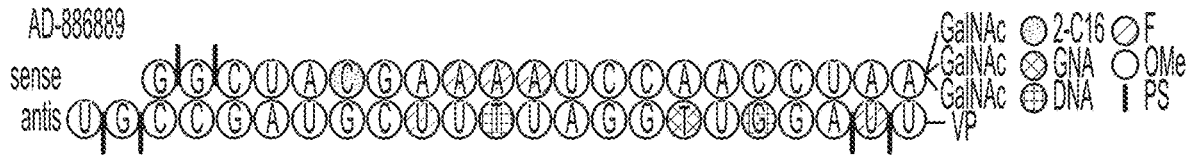
Figure 18B:
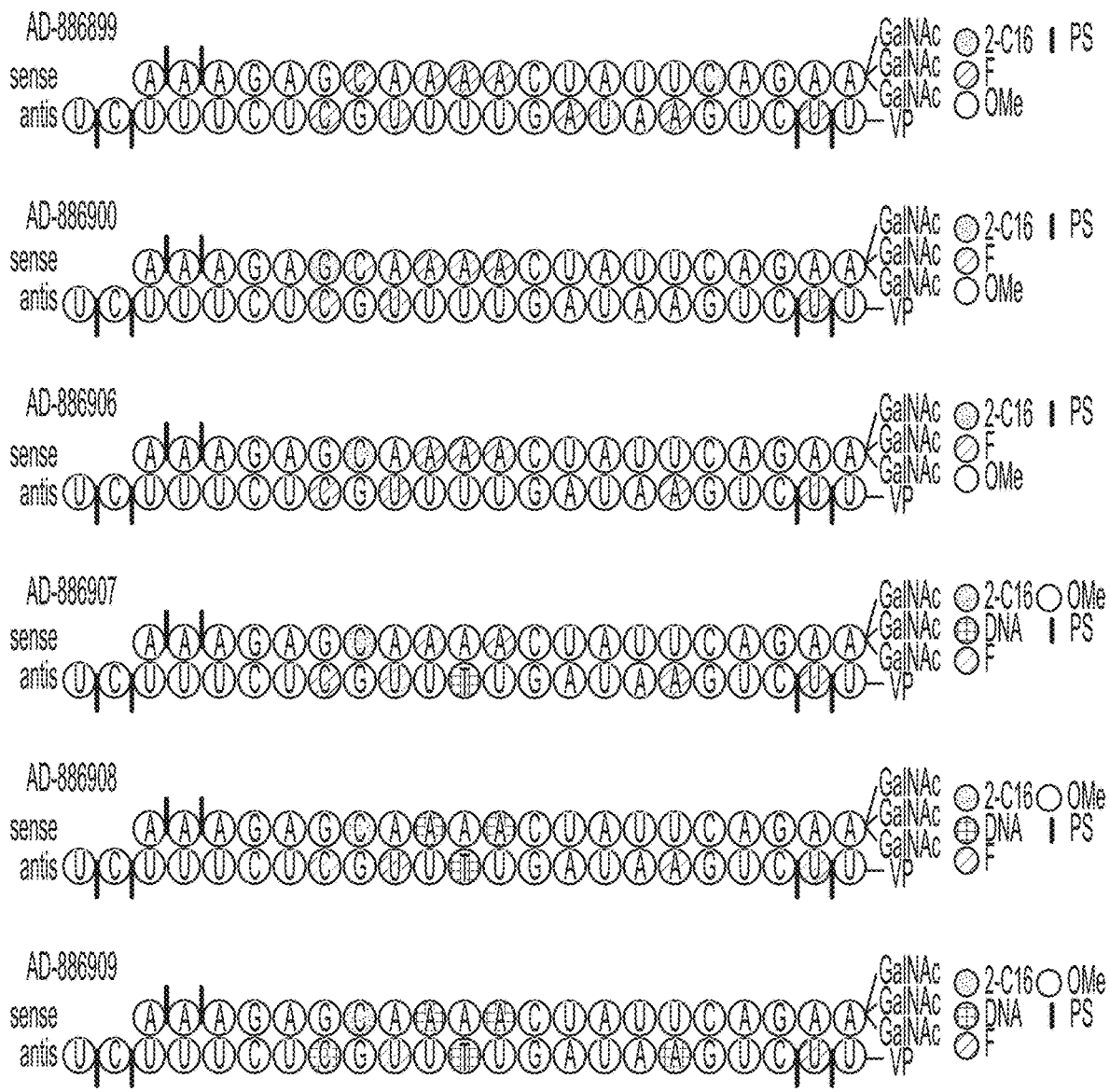
Figure 18C:
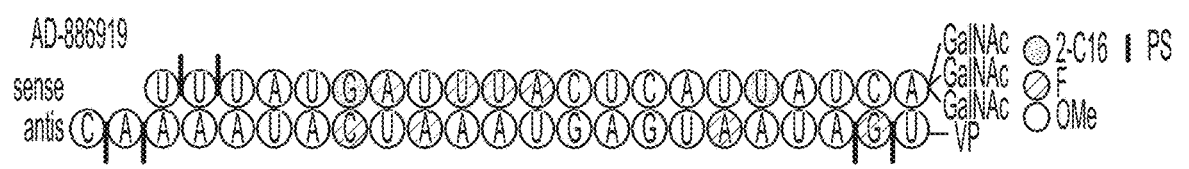
Figure 18C:
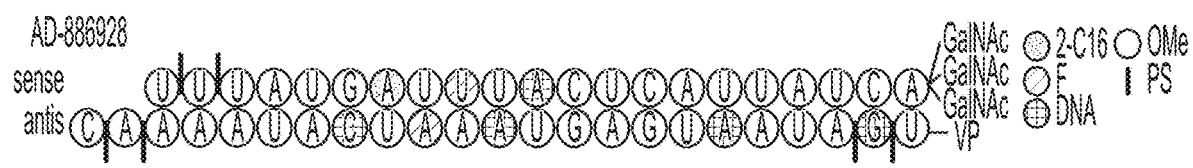
Figure 18C:
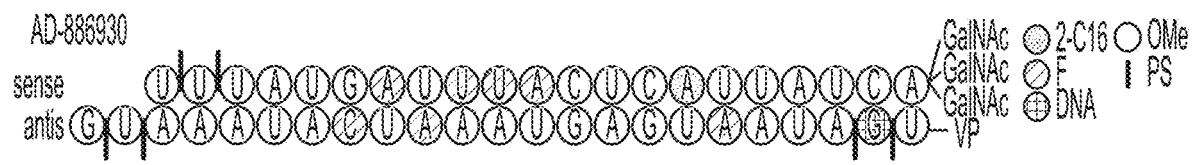
Figure 18C:
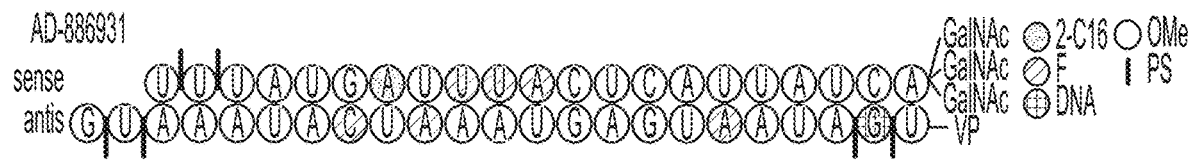
Figure 18D:
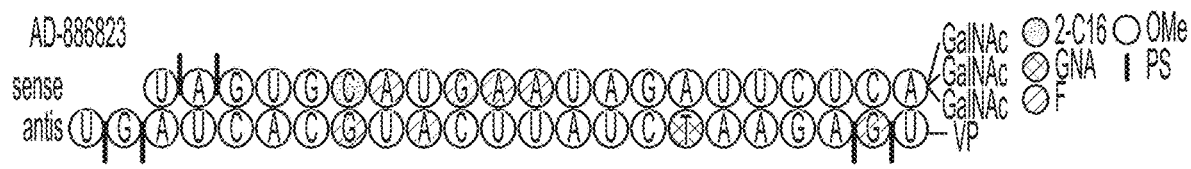
Figure 18D:
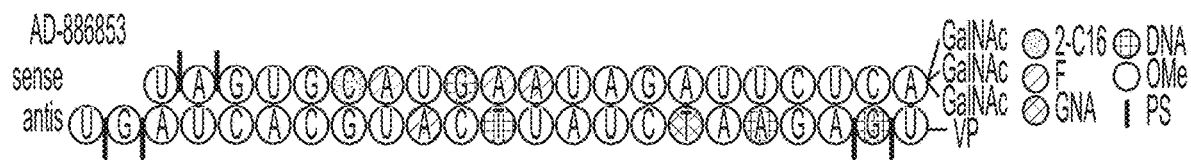
Figure 18D:
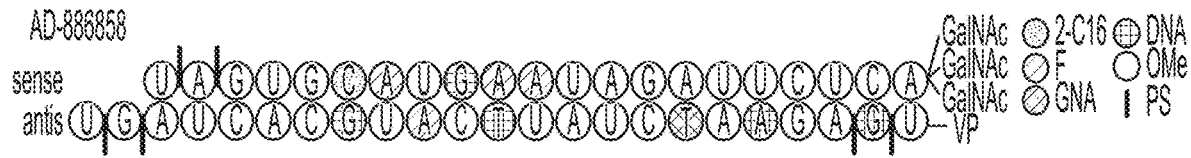
Figure 18D:
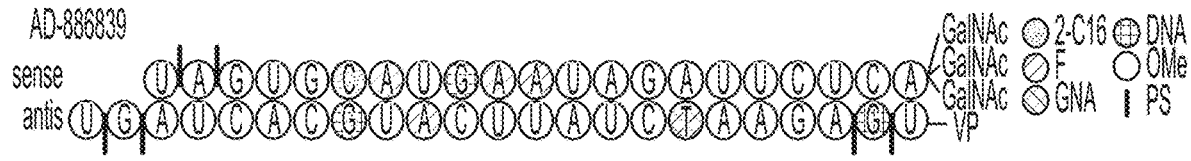
Figure 18D:
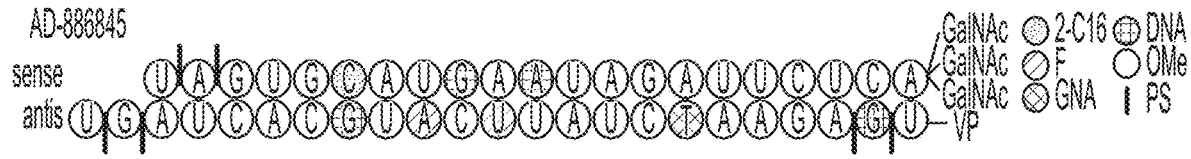

As shown in Table 26, FIG. 17A, and FIG. 17B, significant levels of in vivo human APP mRNA knockdown in liver were observed for most lead RNAi agents tested, as compared to PBS and Naïve (AAV only) controls, with particularly robust levels of knockdown observed for AD-886864 (parent), AD-886873, AD-886879, AD-886883, AD-886884, AD-886889, AD-886899 (parent), AD-886900, AD-886906, AD-886907, AD-886919 (parent), and AD-886823 (parent) FIGS. 18A-18D are schematic representations of the lead RNAi agents classified by parent molecule: AD-886864 parent (FIG. 18A), AD-886899 parent (FIG. 18B), AD-886919 parent (FIG. 18 C), and AD-886823 parent (FIG. 18D), respectively

TABLE 26

Summary of In Vivo Screening Results for Lead Candidates in AAV Mice.

3 mg/kg SC D14 liver qPCR % message remaining

| Treatment | Group Average | Standard Deviation |
|---|---|---|
| PBS | 100.00 | 15.26 |
| naïve (AAV-only) | 104.01 | 16.49 |
| AD-886864 (parent) | 29.55 | 0.93 |
| AD-886873 | 27.48 | 0.84 |
| AD-886877 | 33.34 | 13.46 |
| AD-886879 | 26.68 | 2.52 |
| AD-886883 | 21.74 | 2.25 |
| AD-886884 | 28.51 | 8.66 |
| AD-886889 | 21.77 | 1.58 |
| AD-886899 (parent) | 27.17 | 7.52 |
| AD-886900 | 20.80 | 5.81 |
| AD-886906 | 19.35 | 5.97 |
| AD-886907 | 19.12 | 3.16 |
| AD-886908 | 30.28 | 6.67 |
| AD-886909 | 34.56 | 5.55 |
| AD-886919 (parent) | 24.16 | 6.71 |
| AD-886928 | 40.47 | 5.03 |
| AD-886930 | 32.87 | 6.63 |
| AD-886931 | 38.82 | 4.51 |
| AD-886823 (parent) | 27.81 | 3.36 |
| AD-886853 | 43.59 | 9.18 |
| AD-886858 | 61.16 | 2.23 |

TABLE 26-continued

Summary of In Vivo Screening Results for Lead Candidates in AAV Mice.

3 mg/kg SC D14 liver qPCR % message remaining

| Treatment | Group Average | Standard Deviation |
|---|---|---|
| AD-886839 | 60.35 | 13.85 |
| AD-886845 | 79.73 | 10.09 |

Table 29 shows in vitro APP knockdown of the above-described (e.g., Table 26) lead RNAi agents at either 10 nM or 0.1 nM in Be(2)C cell lines.

TABLE 29

Summary of In Vitro Screening Results for Lead Candidates in Be(2)C Cells at 10 nM and 0.1 nM Doses.

| Duplex | % of Message Remaining - 10 nM | STD EV - 10 nM | % of Message Remaining - 0.1 nM | STD EV - 0.1 nM |
|---|---|---|---|---|
| AD-886823.1 | 7.0 | 5.4 | 91.0 | 25.7 |
| AD-886845.1 | 13.3 | 3.2 | 67.4 | 7.9 |
| AD-886839.2 | 10.2 | 7.7 | 74.7 | 39.5 |
| AD-886853.1 | 6.5 | 3.9 | 44.9 | 7.4 |
| AD-886858.1 | 11.4 | 2.4 | 61.4 | 12.5 |

TABLE 29-continued

Summary of In Vitro Screening Results for Lead Candidates in Be(2)C Cells at 10 nM and 0.1 nM Doses.

| Duplex | % of Message Remaining - 10 nM | STD EV - 10 nM | % of Message Remaining - 0.1 nM | STD EV - 0.1 nM |
|---|---|---|---|---|
| AD-886864.1 | 11.5 | 3.9 | 44.9 | 7.9 |
| AD-886873.1 | 12.7 | 1.9 | 60.2 | 14.3 |
| AD-886877.1 | 11.9 | 3.0 | 67.8 | 5.9 |
| AD-886879.1 | 9.8 | 1.7 | 41.0 | 5.2 |
| AD-886883.1 | 8.5 | 2.1 | 29.5 | 12.8 |
| AD-886884.1 | 8.9 | 2.4 | 31.2 | 11.9 |
| AD-886889.1 | 9.4 | 0.6 | 28.0 | 14.2 |
| AD-886899.1 | 9.2 | 2.6 | 40.5 | 12.7 |
| AD-886900.1 | 6.7 | 2.1 | 39.7 | 21.5 |
| AD-886906.1 | 10.2 | 3.0 | 39.7 | 9.9 |
| AD-886907.1 | 9.8 | 2.7 | 30.3 | 1.9 |
| AD-886908.1 | 10.7 | 2.6 | 32.8 | 10.6 |
| AD-886909.1 | 7.4 | 1.4 | 77.9 | 16.2 |
| AD-886919.1 | 5.7 | 1.4 | 31.2 | 4.3 |
| AD-886928.1 | 9.2 | 2.4 | 67.6 | 7.1 |
| AD-886930.1 | 6.9 | 1.7 | 45.7 | 10.1 |
| AD-886931.1 | 3.2 | 1.2 | 42.0 | 16.0 |

Example 8. In Vivo Knock Down of APP Via C-16 siRNA Conjugates in Non-Human Primates Because of the efficacy of the siRNA conjugate AD-454844, structure activity relationship studies were carried out on AD-454844, and 5 new C16 compounds were then identified as lead compounds based on Cyno monkey in vivo screens of soluble APP. In vivo knock down effects of C16 siRNA conjugates were assessed in Cyno monkeys given 60 mg of AD-454844, AD-994379, AD-961583, AD-961584, AD-961585, or AD-961586 via intrathecal administration between L2/L3 or L4/L5 via percutaneous needle stick in the lumbar cistern (FIGS. 20A-20G). Soluble APP alpha and beta target engagement biomarkers were assessed from CSF collected at D8, D15 and D29 post dose. IT dosing resulted in sufficient siRNA delivery throughout the spine and brain as demonstrated by silencing of target engagement biomarkers as early as one week post dose with sustained activity through D29. Notably, the in vivo knock down activity of the 5' end C16 conjugate (AD-994379) was similar to that of the internal C16 conjugate (AD-454844). (The antisense sequence is identical across both molecules tested).

Figure 19:
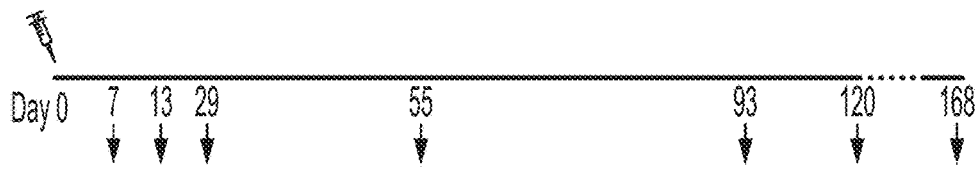
FIG. 19 is a scheme demonstrating the APP knock down non-human primate (NHP) screening study design of the AD-454844 4 month study in which a single intrathecal (IT) injection of 60 mg of the compound of interest was given to Cyno monkeys at the onset.
Figure 20A:
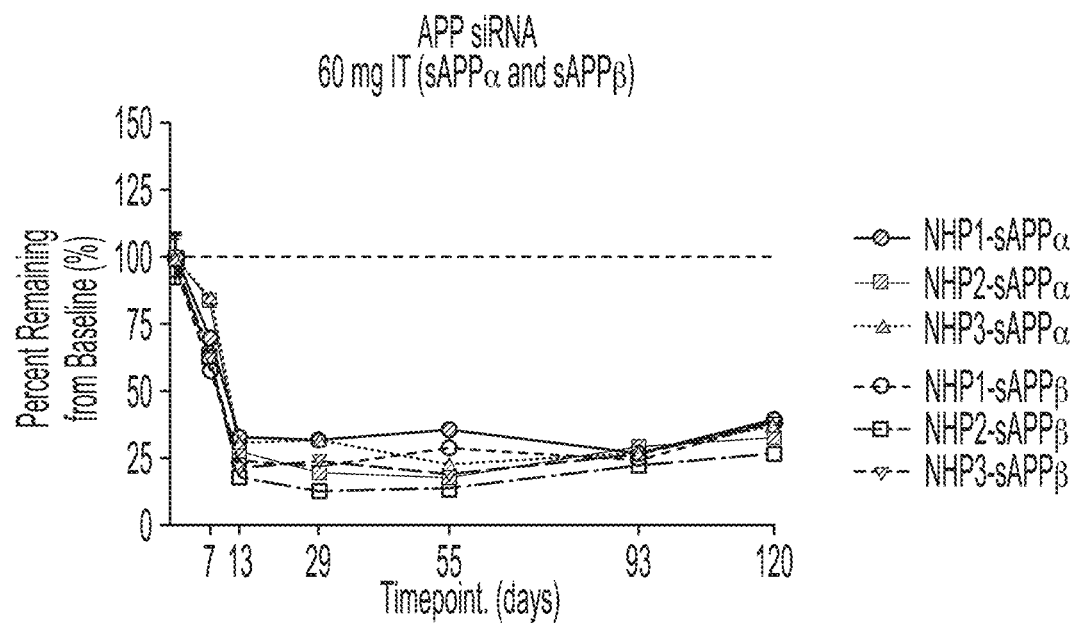
Figure 20B:
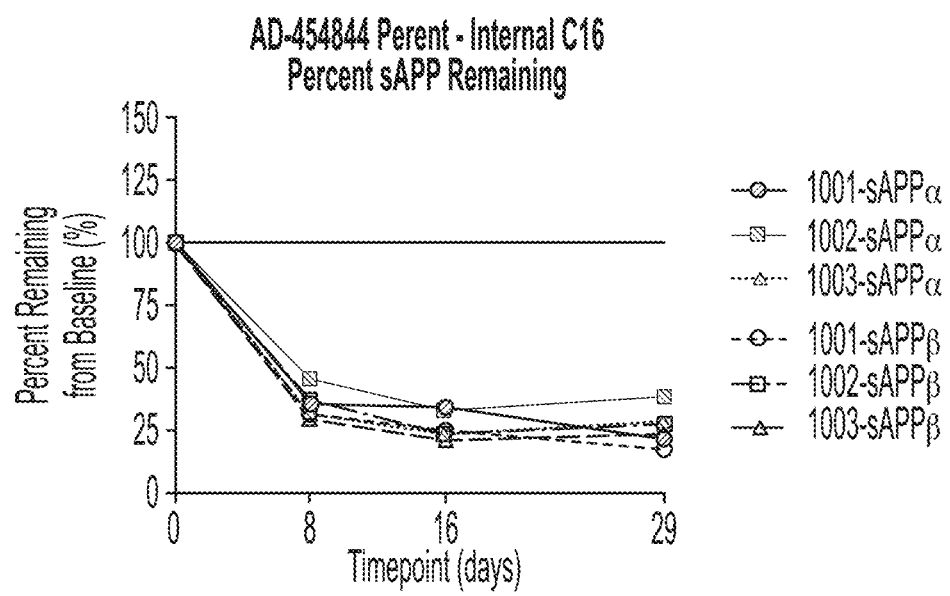
Figure 20C:
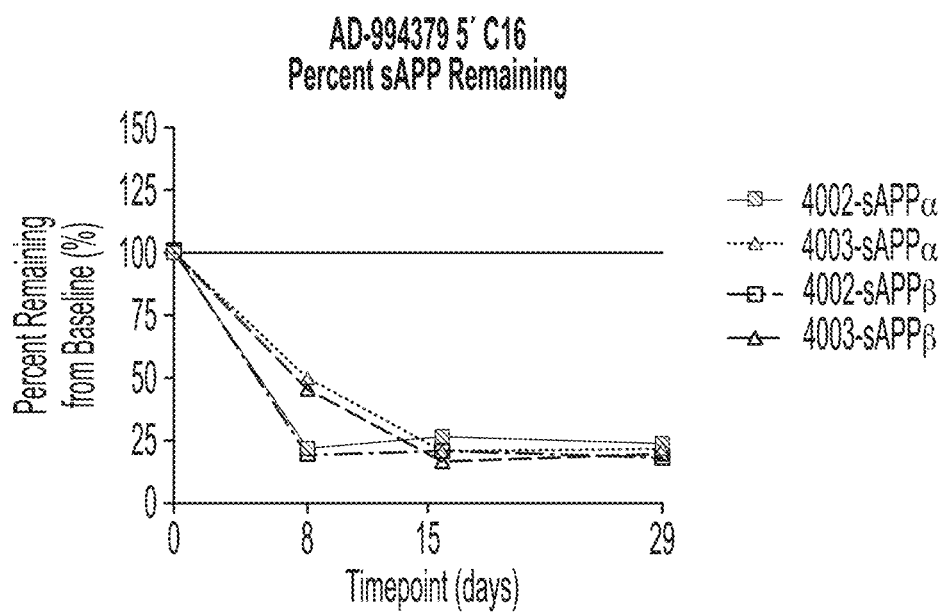
Figure 20D:
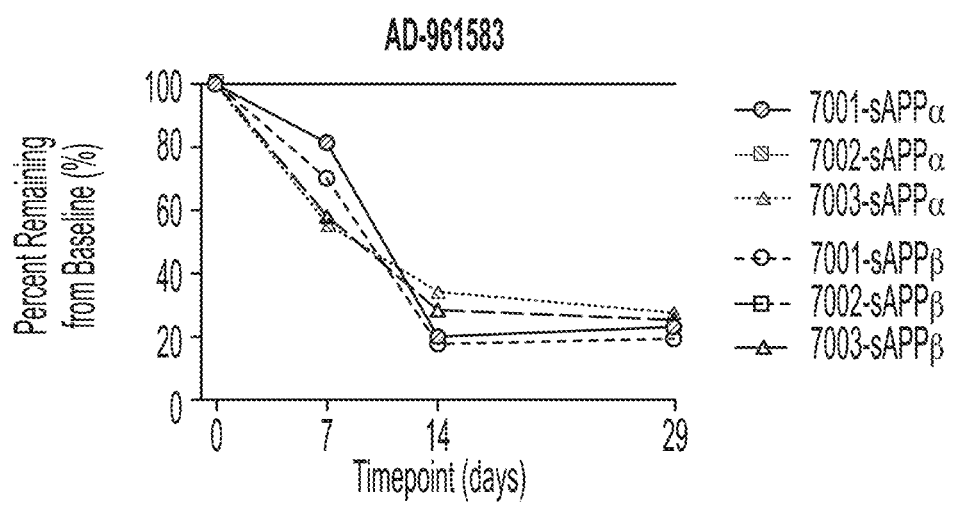
Figure 20E:
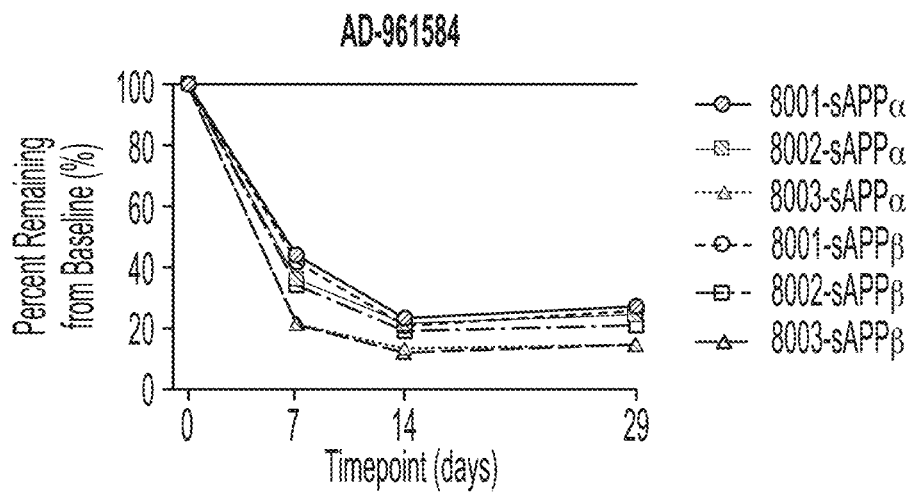
Figure 20F:
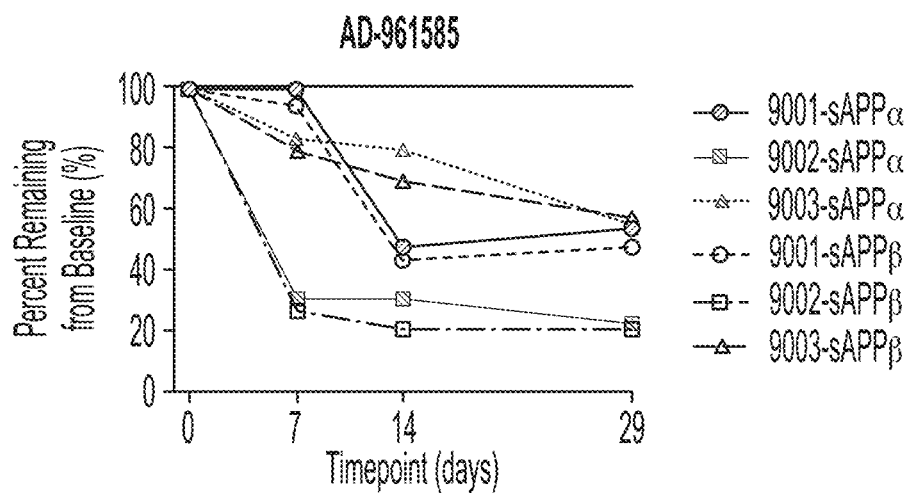
Figure 20G:
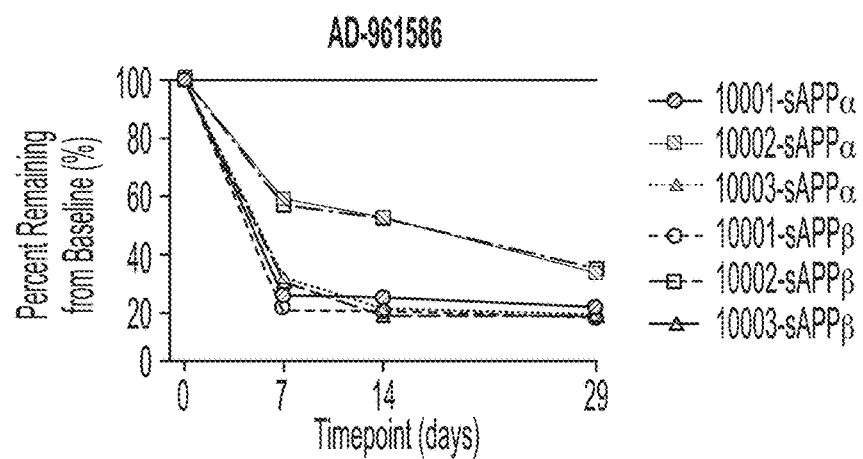
Figure 21A:
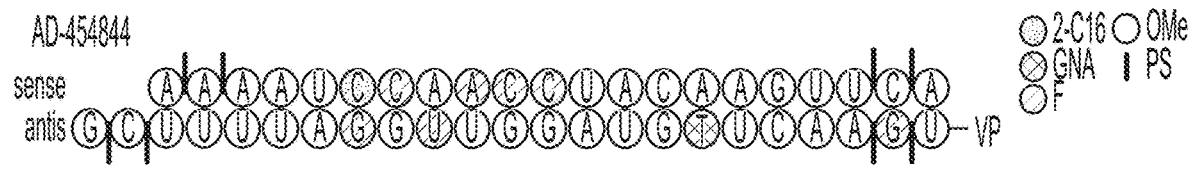
FIGS. 21A and 21B are schematic images of C16 modified lead RNAi agents that were screened for in vivo APP knockdown activity in non-human primates.
Figure 21A:
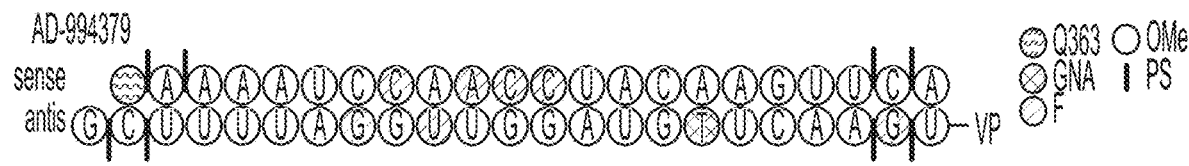
Figure 21B:
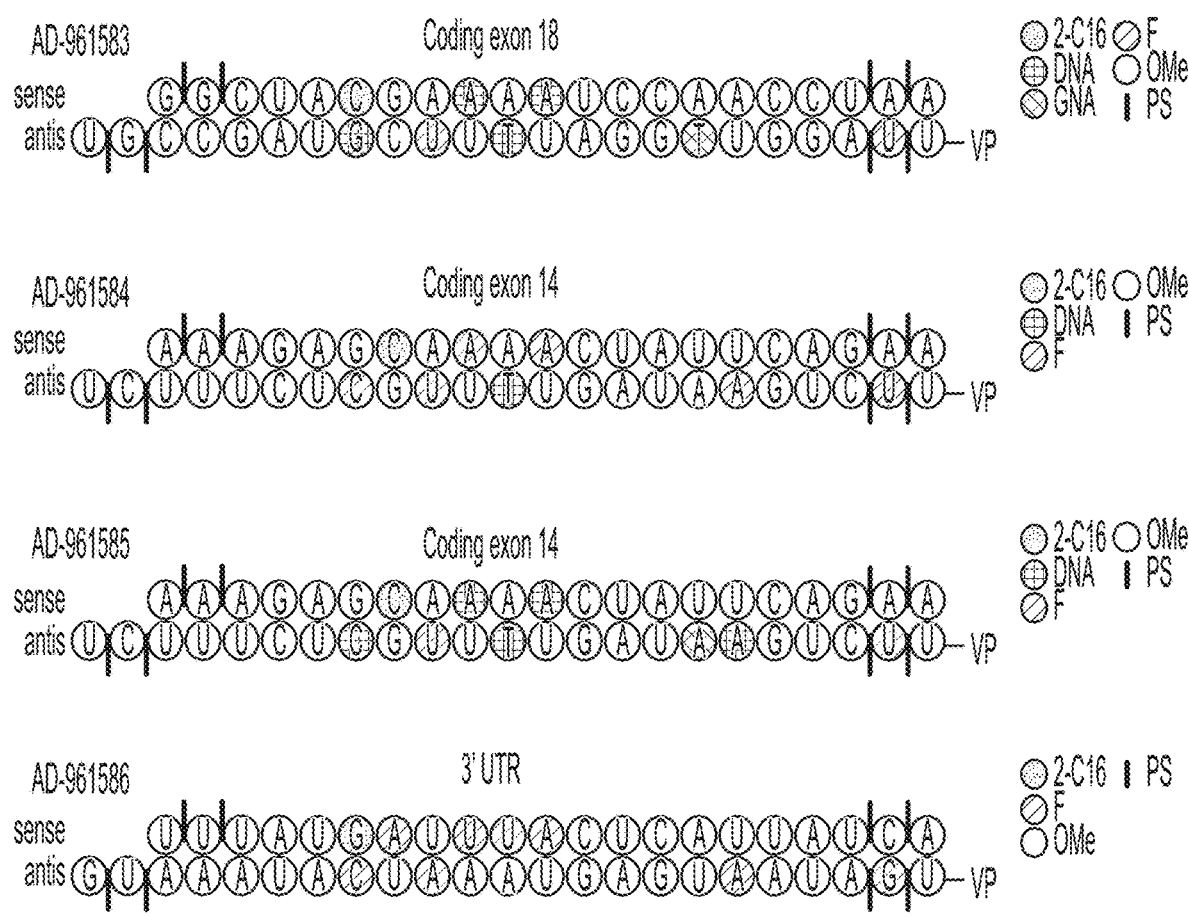

Further, the C16 siRNA conjugates exhibited a significant long lasting knock down effect. Sustained pharmacodynamic effects in which soluble APP remained well below 50% over a 4 month period were observed following a single dose of 60 mg of AD-454844 (FIGS. 19 and 20A).

TABLE 30

C16 siRNA conjugates identified to knock down APP in in vivo NHP studies

| Duplex | Strand | Oligonucleotide Sequence | SEQ ID NO: | Target Sequence | SEQ ID NO: |
|---|---|---|---|---|---|
| AD-994379 | Sense (5' to 3') | Q363sasaaaucCfaAfCfCfuacaaguuscsa | 2873 | CGAAAAUCCAACCUACAAGUUCU | 2883 |
| | Antisense (5' to 3') | VPusGfsaacu(Tgn)guagguUfgGfauuuuscsg | 2874 | AGAACUUGUAGGUUGGAUUUUCG | 2884 |
| AD-961583 | Sense (5' to 3') | gsgscua(Chd)gadAadAuccaaccusasa | 2875 | ACGGCUACGAAAAUCCAACCUAC | 2885 |
| | Antisense (5' to 3') | VPusUfsaggu(Tgn)ggaudTuUfcdGuagccsgsu | 2876 | GUAGGUUGGAUUUUCGUAGCCGU | 2886 |
| AD-961584 | Sense (5' to 3') | asasagag(Chd)aAfaAfcuauucagsasa | 2877 | AGAAAGAGCAAAACUAUUCAGAU | 2887 |
| | Antisense (5' to 3') | VPuUfcugAfauagudTuUfgCfcuuuscsu | 2878 | AUCUGAAUAGUUUUGCUCUUUCU | 2888 |
| AD-961585 | Sense (5' to 3') | asasagag(Chd)adAadAcuauucagsasa | 2879 | AGAAAGAGCAAAACUAUUCAGAU | 2889 |
| | Antisense (5' to 3') | VPuUfcugdAauagudTuUfgdCucuuuscsu | 2880 | AUCUGAAUAGUUUUGCUCUUUCU | 2890 |
| AD-961586 | Sense (5' to 3') | ususuau(Ghd)AfuUfUfAfcucauuauscsa | 2881 | GUUUUAUGAUUUACUCAUUAUCG | 2891 |
| | Antisense (5' to 3') | VPusGfsauaAfugaguaaAfuCfauaaasusg | 2882 | CGAUAAUGAGUAAAUCAUAAAAC | 2892 |

TABLE 29

Unmodified base transcripts used in the C16 conjugates of Table 30.

| Duplex | Strand | Oligo name | Transcript Sequence | SEQ ID NO: |
|---|---|---|---|---|
| AD-994379 | Sense (5' to 3') | A-1701871.1 | AAAAUCCAACCUACAAGUUCA | 2893 |
| | Antisense (5' to 3') | A-882382.1 | UGAACUTGUAGGUUGGAUUUUCG | 2894 |
| AD-961583 | Sense (5' to 3') | A-1770584.1 | GGCUACGAAAAUCCAACCUAA | 2895 |
| | Antisense (5' to 3') | A-1683088.1 | UUAGGUTGGAUUUUCGUAGCCGU | 2896 |
| AD-961584 | Sense (5' to 3') | A-1770585.1 | AAAGAGCAAAACUAUUCAGAA | 2897 |
| | Antisense (5' to 3') | A-1683116.1 | UUCUGAAUAGUTUUGCUCUUUCU | 2898 |
| AD-961585 | Sense (5' to 3') | A-1770586.1 | AAAGAGCAAAACUAUUCAGAA | 2899 |
| | Antisense (5' to 3') | A-1683118.1 | UUCUGAAUAGUTUUGCUCUUUCU | 2900 |
| AD-961586 | Sense (5' to 3') | A-1770587.1 | UUUAUGAUUUACUCAUUAUCA | 2901 |
| | Antisense (5' to 3') | A-1683134.1 | UGAUAAUGAGUAAAUCAUAAAUG | 2902 |

SEQUENCE LISTING (2902 sequences)

SEQ ID NO: 1 - DNA, 3423 bp, Homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 2 - DNA, 3648 bp, Homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 3 - DNA, 3591 bp, Homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 4 - DNA, 3572 bp, Homo sapiens
aaatagcacagccttgctgtgcgtggtagaagttgggttagtgttgacatgctgttgactcaccctcccgaggatggaagctctggcctgggtcaagttgtggtcactgcagttaacagtttgttgatctcagggagtattccacagttgctgatgtaattgacaatgattggagccagctcttccccagattcaaatggaccaattagaggacttgttggttctgtttatcaactatgtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 5 - DNA, 3255 bp, Homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 6 - DNA, 3480 bp, Homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 7 - DNA, 3310 bp, Homo sapiens
gtcggatgattcaagctcacggggacgagcaggagcgctctcgacttttctagagcctcagcgtcctaggactcacctttccctgatcctgcaccgtccctctcctggccccagactctccctcccactgttcacgaagcccaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 8 - DNA, 3594 bp, Homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 9 - DNA, 3537 bp, Homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 10 - DNA, 3369 bp, Homo sapiens
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 11 - DNA, 1795 bp, Homo sapiens
gtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttggtaagtaagctgttc

SEQ ID NO: 12 - DNA, 3926 bp, Macaca fascicularis
agctcacggggacgagcgggagcgctcccgacttttctagagccccagcgtcctaggactcacctttccctgatcctgcaccgtccctctcctggccccagactctccctcccactgttcccgaagcccaggtgggctgtctgccggggagctgaggagggcgcgtgtggtgcaggcggcgcctagggcgctgcacctgtgggcccggggcgcgcgggcccctcccggcgcgagcgggcgcagctccccggcggcgccgctaggggtctctctcgagtgccgagcggggtgggccggatcagctgacttgcctggctccgagcctcgccgccgcgctcctgctccgtcagtttcctcggcagcggtaggcgagagcactcggagcagcgcgcgcgggggcccccggagacggcggcggtggcgcgggcagagcaaggacgcggcggatcccactcgcacagcagcgcactcggtgccccgcgcagggtcgcgatgctgcccggtttggcactgctcctgctggccgcctggacggctcgggcgctggaggtacctactgatggcaatgctggcctgctggctgaaccccagatcgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgtttagttggtgagtttgtaagcgatgcccttctcgttcctgacaagtgcaaattcttacaccaggagaggatggatgtttgcgaaactcatcttcactggcacaccgtcgccaaagagacgtgcagtgagaagagcaccaacttgcatgactacggcatgttgctgccctgcggaatcgataagttccgaggggtagagtttgtgtgttgcccactggctgaggaaagtgacaatgtggattctgctgatgcggaggaggatgactcggatgtctggtggggcggagcagacacagactatgcagacgggagtgaagacaaagtagtagaagtagcagaggaggaagaagtggccgaggtggaagaagaagaagccgatgatgacgaggacgatgaggatggtgatgaggtagaggaagaggctgaggaaccctacgaagaagccacagagagaaccaccagcatcgccaccaccaccaccaccaccacggagtctgtggaagaggtggttcgagaggtgtgctctgaacaagccgagacggggccatgccgagcaatgatctcccgctggtactttgatgtgactgaagggaagtgtgccccattcttttacggcggatgtggcggcaaccggaacaactttgacacagaagagtactgcatggccgtgtgtggcagcgtcatgtcccaaagtttacgcaagactacccgggaacctcttacccgagatcctgttaaacttcctacaacagcagccagtacccctgatgccgttgacaagtaccttgagacacctggggatgagaatgaacacgcccatttccagaaagccaaagagagacttgaggccaagcaccgagagagaatgtcccaggtcatgagagaatgggaagaggcagaacgtcaggcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcactgctctgcaggccgttcctcctcggcctcgtcacgtgttcaatatgctgaagaagtacgtccgcgcagaacagaaggacagacagcacaccctgaagcatttcgagcatgtacgcatggtggatcccaagaaagctgctcagatccggtcccaggttatgacacacctccgtgtgatttacgagcgcatgaatcagtccctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccgtctttgaccgaaacgaaaactaccgtggagcttcttcccgtgaatggagagttcagcctggacgatcttcagccgtggcattctttcggggctgactctgtgccagccaacacagaaaacgaagttgagcctgttgatgcccgccctgctgccgaccgaggactgaccactcgaccaggttctgggttgacaaatatcaagacagaggagatctctgaagtgaagatggatgcagaattccgacatgactcaggttatgaagttcatcatcaaaaattggtgttctttgccgaagatgtgggttcaaacaaaggtgcaatcattggtctcatggtgggcggtgttgtcatagcaacagtgatcgtcatcaccttggtgatgctgaagaagaaacagtacacgtccattcatcatggtgtggtggaggttgacgccgctgtcaccccagaggagcgccacctgtccaagatgcagcagaacggctatgaaaatccaacctacaagttctttgagcagatgcagaactagacccccgccacagcagcctctgaagttggacagcaaaaccattgcttcactacccatcggtgtccatttatagaatactgtcggaagaaacaaacccctctgttttatgatttactcattatcgccttttgacagctgtgctgtaacacaagtagatgcctgaacttgaattaatccacaaatcagtaatgtattctctctctctttacattttggtctctacactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagtttagctgcttctcttgcctaagtattcctttcctgatcactatgcattttaaagttaaacatttttaagtacttcagatgctttagagagattttttttccacgattgcattttactgtacagattgctgcttctgctatatttgtgatataggaattaagaggatacacgtttgtttctttgtgcctgttttatgtgcacacattaggcattgagacttcgagcttttttttttgtccacgtatctttgggtctttgataaagaaaagaatccctgttcattgtaagcacttttacggggcgggtggggaggggtgctctgctggtcttaaattaccaagaattctccaaaaaatatttctgcaggatgattgtacagaatcattgcttatgacatgatcgctttctacactgtattacataaataaattaaataaaataaccctgggcaagacttttctttgaaggatgactccagacattaaacagtcaaagtaattctgggcggggagagaagaggcagattcaattttctttaaccagtctgaagttttatttatgatacaacagaagatgaaaatggaagtggcaatataagggaaggaggaaggcatgcctggacaaacccttctttaagatgtgtcttcaatttgtataaaatggtgttttcatgtaaataaatacattcttggaggagca

SEQ ID NO: 13 - DNA, 3377 bp, Mus musculus
gtcagtttcctcggcggcgggaggcgagagcaccgggagcagagcgagcgcggggccaccggagacggcggcggcggcgcggacacagccagggcgcggcggatcttccactcgcacacggagcactcggtggcccacgcaggatcacgatgctgcccagcttggcactgctcctgctggccgcctggacggttcgggctctggaggtacccactgatggcaacgccgggctgctggcagaaccccagatcgccatgttctgtggtaaactcaacatgcacatgaatgtgcagaatggaaagtgggagtcagacccgtcagggaccaaaacctgcattggcaccaaggagggcatcttgcagtactgccaagaggtctaccctgaactgcagatcacaaacgtggtggaagccaaccagccagtgaccatccagaactggtgcaagcggggccgcaagcagtgcaagacacacacccacatcgtgattccttaccgttgcctagttggtgagtttgtgagcgacgcccttctcgtgcccgacaagtgcaagttcctacaccaggagcggatggatgtttgtgagacccatcttcactggcacaccgtcgccaaagagacatgcagcgagaagagcactaacttgcacgactatggcatgctgctgccctgcggcatcgacaagttccgaggggtagagtttgtatgctgcccgttggccgaggaaagcgacagcgtggattctgcggatgcagaggaggatgactctgatgtctggtggggtggagcggacacagactacgctgatggcggtgaagacaaagtagtagaagtcgccgaagaggaggaagtggctgatgttgaggaagaggaagctgatgatgatgaggatgtggaggatggggacgaggtggaggaggaggccgaggagccctacgaagaggccaccgagagaacaaccagcactgccaccaccaccacaaccaccactgagtccgtggaggaggtggtccgagaggtgtgctctgaacaagccgagaccgggccatgccgcgcaatgatctcccgctggtactttgatgtcactgaagggaagtgtgtcccattcttttacggcggatgtggcggcaacaggaacaactttgacacggaagagtactgcatggcggtgtgtggcagcgtgtcaacccaaagtttactcaagactaccagtgaacctcttccccaagatcctgataaacttcccacgacagcagccagcacccccgacgccgtcgacaagtacctggagacacccggggacgagaacgagcatgcccatttccagaaagccaaagagaggctggaagccaagcaccgagagagaatgtcccaggtcatgagagaatgggaagaggcagagcgtcaagccaagaacttgcccaaagctgacaagaaggccgttatccagcatttccaggagaaagtggaatctctggaacaggaagcagccaatgagagacagcagcttgtagagacacacatggccagagttgaagccatgctcaatgaccgccgccgcctggccctcgagaattacatcactgcactgcaggcggtgcccccaaggcctcatcatgtgttcaacatgctgaagaagtacgtccgtgcggagcagaaagacagacagcacaccctaaagcattttgaacatgtgcgcatggtggaccccaagaaagctgctcagatccggtcccaggttatgacacacctccgtgtgatctacgagcgcatgaaccagtctctgtccctgctctacaatgtccctgcggtggctgaggagattcaagatgaagtcgatgagctgcttcagaaggagcagaactactccgacgatgtcttggccaacatgatcagtgagcccagaatcagctacggaaacgacgctctcatgccttcgctgacggaaaccaagaccaccgtggagctccttcccgtgaatggggaattcagcctggatgacctccagccgtggcacccttttggggtggactctgtgccagccaataccgaaaatgaagtcgagcctgttgacgcccgccccgctgctgaccgaggactgaccactcgaccaggttctgggctgacaaacatcaagacggaagagatctcggaagtgaagatggatgcagaattcggacatgattcaggatttgaagtccgccatcaaaaactggtgttctttgctgaagatgtgggttcgaacaaaggcgccatcatcggactcatggtgggcggcgttgtcatagcaaccgtgattgtcatcaccctggtgatgttgaagaagaaacagtacacatccatccatcatggcgtggtggaggtcgacgccgccgtgaccccagaggagcgccatctctccaagatgcagcagaacggatatgagaatccaacttacaagttctttgagcaaatgcagaactaagccccacccgcgccacagcagcggcctctgaacttggacagcgaaaccattgcttcactacccatcggtgttcatttataaaataacgtggaaagaaacaaacccttccgtttatttactcaccctcggcttttgacagctgtgctgtaacacaagtagatgcctgaacttgaattaatatacaaatcagtaatgtattctcgctttctctctttacattctggtctctacattacatgattcatgggttttgtgtactgtaaaaaaaaaaattagctgtatcaaactagtgcatgaatagattctctcctaattatttatcacatacatagccccttagcccgttgtatattattcttgtggtttgtggcccggaaaaaactcctacttgaaatatgctttaaaaatcgatgggggatgcttcttgtgaacgtgggcgtctagctgcttctcctacgtattcttttcctgatcactatgcattttgaacatttttttaagtattccaaatgacttagaaaattctttttccatgactgcatcttactgtacagattgctgcttctgctctctttgtgatataggaataagaggatacacattgatttctttgtgcctgttttatgtgcacacattaggcattgagaatttgaacattttttttgtccatgtatctttggatctttgataaaaaaaaattaaaaaaaaattatccctgttcatcataagcacttttacgggtggggggagggagtgttctgctggtctccaattaccaagaattctccaaaaattaattttctgcaggatgattgtacagaatcattgcttatgccatgatagctttctacactgtattacataaataaattaaataaaataactccaggcaagaaaaaaaaaaaaaaaaaaaaa

SEQ ID NO: 14 - DNA, 2340 bp, Rattus rattus
gtcggtggcccacgcaggatcacgatgctgcccagcctggcactgctcctgctggccgcctggacggttcgggctctggaggtgcccactgatggcaatgccggtctgctggcagaaccccagatcgccatgttctgtggtaaactcaacatgcacatgaatgtgcagaatggaaaatgggagtcagacccatcagggaccaaaacctgcattggcaccaaggagggaatcctgcagtactgccaagaggtctaccctgaactgcagatcacaaacgtggtggaagccaaccagccagtgaccatccagaactggtgcaagcggggccgcaagcagtgcaagacgcacacccacatcgtgattccttaccggtgcctagttggtgagtttgtaagcgatgcccttctcgtgcccgacaagtgcaagtttctacaccaggagcggatggacgtttgtgagacccatcttcactggcatactgttgccaaagagacatgcagtgagaagagcactaacttgcacgactatggcatgctgctgccctgtggcatcgacaagttccgaggggtcgagttcgtgtgctgcccgttggcggaggagagcgacagcatcgattctgcggacgcagaggaggacgactccgatgtctggtggggtggagcggacacagactatgctgatggcggtgaagacaaagtcgtagaagtagccgaagaggaggaagtggccgatgttgaggaagaagaagctgaggatgacgaggatgtggaggatggggatgaggtggaggaggaggccgaggagccctacgaagaggccacagagagaacaaccagcattgccaccactaccacaactaccactgagtctgtggaggaggtagtccgagaggtgtgctctgaacaagctgagaccgggccatgccgtgcaatgatctcccgctggtactttgatgtcactgaaggaaagtgcgccccattcttttacggcggatgtggcggcaacaggaacaactttgacactgaagagtactgcatggcggtgtgtggcagcgtgtcatcccaaagtttactcaagactaccagtgaacctcttccccaagatccggttaaacttcccacgacggcagccagcacccctgacgcagtcgacaagtacctggagacccccggagatgagaacgagcacgcccatttccagaaagccaaagagaggttggaagccaagcaccgagagagaatgtcccaggtcatgagagaatgggaggaggcagaacgtcaagccaagaatttgcccaaagctgacaagaaggccgttatccagcatttccaggagaaagtggaatctctggaacaggaagcagccaacgagaggcagcagcttgtagagacacacatggccagagttgaagccatgctcaatgatcgccgtcgcctggccctcgagaattacatcaccgcactgcaggcggtgcctccaaggcctcatcatgtgttcaacatgctgaagaagtacgtccgtgcagagcagaaggacagacagcacaccctaaagcattttgaacatgtgcgcatggtggaccccaagaaagctgctcagatccggtcccaggttatgacacacctccgtgtgatctacgagcgcatgaaccagtctctgtccctgctctacaacgtccctgccgtggctgaggagattcaagatgaagttgacgagctgcttcagaaggagcagaactactccgacgacgtcttagccaacatgatcagtgaacccagaatcagttacggcaacgatgctctcatgccttctttgactgaaacgaagaccactgtggagctccttcccgtgaatggcgaattcagcctggatgatctccaaccgtggcatccttttggggtggactctgtgccagccaatacagaaaatgaagttgagcctgtcgacgcccgccccgctgctgaccgaggactgaccactcgaccagggtctgggttgacaaacatcaagacagaagagatctcagaagtgaagatggatgcggagttcggacatgattcaggcttcgaagtccgccatcaaaaactggtgttctttgcagaagatgtgggttcaaacaaaggtgccatcattggactcatggtgggtggcgttgtcatagcaacagtgattgtcatcaccttggtgatgctgaagaagaaacagtacacatccatccatcatggcgtggtggaggttgacgctgctgtgaccccggaggagcgccacctctccaagatgcagcagaatggatatgagaatccaacatacaagttctttgagcagatgcagaactaaacc

SEQ ID NO: 15 - DNA, 3423 bp, Homo sapiens
ttttttttttttttttgctcctccaagaatgtatttatttacatgaaaacaccattttatacaaattgaagacacatcttaaaagaagggtttgtccaggcatgccttcctcatccccttatattgccacttccattttcatcttcttttgtatcataaatgaaacttcagactggttaaagaaaattgaatctgcctcttctccccacccaaaattacttcgattatttaatgtctgtagtcatccttcaaagaaaagtcttgcccggggttattttatttaatttatttatgtaatacagtgtagaaagcgatcatgtcataagcaatgattctgtacaatcatcctgcagaaaattgttttggagaattcttggtaattgaagaccagcagagcacccctccccacccgccccgtaaaagtgcttacaatgaacagggattcttttctttatcaaagacccaaagatacgtggacaaaaaaagaaaagcttgaagtctcaatgcctaatgtgtgcacataaaacaggcacgaagaaacaaacgtgtgtatcctcttaattcctatatcacaaatatagcagaagcagcaatctgtacagtaaaatgcagtcatggaaaaaaaatctctctaaagcatctgaaatacttaaaaatgtttaactttaaaatgcatagtgatcaggaaaggaatacttaggcaagagaagcagctgaactcccacgttcacatgaagcatcccccatcgattcttaaagcatatgtaaagtaggacttaattgggtcacaaaccacaagaataatatacaactggctaaggggctatgtgataaataatcaggagagaatctattcatgcactagtttgatacagctaaattctttacagtacacaaaacccattaataatgtagtatagagaccaaaatgtaaagagagatagaatacattactgatgtgtggattaattcaagttcaggcatctacttgtgttacagcacagctgtcaaaaggcgataatgagtaaatcataaaacgggtttgtttcttcccacattattctataaatggacaccgatgggtagtgaagcaatggttttgctgtccaacttcagaggctgctgtggcgggggtctagttctgcatctgctcaaagaacttgtaggttggattttcgtagccgttctgctgcatcttggacaggtggcgctcctctggggtgacagcggcgtcaacctccaccacaccatgatgaatggatgtgtactgtttcttcttcagcatcaccaaggtgatgacgatcactgtcgctatgacaacaccgcccaccatgagtccaatgattgcacctttgtttgaacccacatcttctgcaaagaacaccaatttttgatgatgaacttcatatcctgagtcatgtcggaattctgcatccatcttcacttcagagatctcctccgtcttgatatttgtcaacccagaacctggtcgagtggtcagtcctcggtcggcagcagggcgggcatcaacaggctcaacttcgttttctgtgttggctggcacagagtcagccccaaaagaatgccacggctggagatcgtccaggctgaactctccattcacgggaaggagctccacggtggttttcgtttcggtcaaagatggcatgagagcatcgtttccgtaactgatccttggttcactaatcatgttggccaagacgtcatctgaatagttttgctctttctgaagcagctcatcaacttcatcctgaatctcctcggccactgcaggcacgttgtagagcagggagagagactgattcatgcgctcataaatcacacggaggtgtgtcataacctgggaccggatctgagcggctttcttgggatccaccatgcgcacatgctcgaaatgctttagggtgtgctgtctgtccttctgttctgcgcggacatacttctttagcatattgaacacgtgacgaggccgaggaggaacagcctgcagagcggtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcttgacgttctgcctcttcccattctctcatgacctgggacattctctctcggtgcttggcctcaagcctctctttggctttctggaaatgggcatgttcattctcatccccaggtgtctcgagatacttgtcaacggcatcaggggtactggctgctgttgtaggaactcgaaccacctcttccacagactctgtggtggtggtggtggtggtggcaatgctggtggttctctctgtggcttcttcgtagggttcctcagcctcttcctctacctcatcaccatcctcatcgtcctcgtcatcatcggcttcttcttcttccacctcagccacttcttcctcctctgctacttctactactttgtcttcactcccatctgcatagtctgtgtctgctccgccccaccagacatccgagtcatcctcctccgcatcagcagaatccacattgtcactttcttcagccagtgggcaacacacaaactctacccctcggaacttgtcaattccgcagggcagcaacatgccgtagtcatgcaagttggtactcttctcactgcatgtctctttggcgacggtgtgccagtgaagatgagtttcgcaaacatccatcctctcctggtgtaagaatttgcacttgtcaggaacgagaagggcatcacttacaaactcaccaactaagcagcggtagggaatcacaaagtggggatgggtcttgcactgcttgcggccccgcttgcaccagttctggatggtcactggttggttggcttctaccacattggtgatctgcagttcagggtagacttcttggcaatactgcaggatgccttccttggtatcaatgcaggttttggtccctgatggatctgaatcccacttcccattctggacattcatgtgcatgttcagtctgccacagaacatggcaatctggggttcagccagcaggccagcattaccatcagtgggtacctccagcgcccgagccgtccaggcggccagcaggagcagtgccaaaccgggcagcatcgcgaccctgcgcggggcaccgagtgcgctgctgtgcgagtgggatccgccgcgtccttgctctgcccgcgccgccaccgccgccgtctcccggggcccccgcgcacgctcctccgcgtgctctcgcctaccgctgccgaggaaactgacggagcccgagcgcggcggcggggctcagagccaggcgagtcagctgatcc

SEQ ID NO: 16 - DNA, 3648 bp, Homo sapiens
ttttttttttttttttgctcctccaagaatgtatttatttacatgaaaacaccattttatacaaattgaagacacatcttaaaagaagggtttgtccaggcatgccttcctcatccccttatattgccacttccattttcatcttcttttgtatcataaatgaaacttcagactggttaaagaaaattgaatctgcctcttctccccacccaaaattacttcgattatttaatgtctgtagtcatccttcaaagaaaagtcttgcccggggttattttatttaatttatttatgtaatacagtgtagaaagcgatcatgtcataagcaatgattctgtacaatcatcctgcagaaaattgttttggagaattcttggtaattgaagaccagcagagcacccctccccacccgccccgtaaaagtgcttacaatgaacagggattcttttctttatcaaagacccaaagatacgtggacaaaaaaagaaaagcttgaagtctcaatgcctaatgtgtgcacataaaacaggcacgaagaaacaaacgtgtgtatcctcttaattcctatatcacaaatatagcagaagcagcaatctgtacagtaaaatgcagtcatggaaaaaaaatctctctaaagcatctgaaatacttaaaaatgtttaactttaaaatgcatagtgatcaggaaaggaatacttaggcaagagaagcagctgaactcccacgttcacatgaagcatcccccatcgattcttaaagcatatgtaaagtaggacttaattgggtcacaaaccacaagaataatatacaactggctaaggggctatgtgataaataatcaggagagaatctattcatgcactagtttgatacagctaaattctttacagtacacaaaacccattaataatgtagtatagagaccaaaatgtaaagagagatagaatacattactgatgtgtggattaattcaagttcaggcatctacttgtgttacagcacagctgtcaaaaggcgataatgagtaaatcataaaacgggtttgtttcttcccacattattctataaatggacaccgatgggtagtgaagcaatggttttgctgtccaacttcagaggctgctgtggcgggggtctagttctgcatctgctcaaagaacttgtaggttggattttcgtagccgttctgctgcatcttggacaggtggcgctcctctggggtgacagcggcgtcaacctccaccacaccatgatgaatggatgtgtactgtttcttcttcagcatcaccaaggtgatgacgatcactgtcgctatgacaacaccgcccaccatgagtccaatgattgcacctttgtttgaacccacatcttctgcaaagaacaccaatttttgatgatgaacttcatatcctgagtcatgtcggaattctgcatccatcttcacttcagagatctcctccgtcttgatatttgtcaacccagaacctggtcgagtggtcagtcctcggtcggcagcagggcgggcatcaacaggctcaacttcgttttctgtgttggctggcacagagtcagccccaaaagaatgccacggctggagatcgtccaggctgaactctccattcacgggaaggagctccacggtggttttcgtttcggtcaaagatggcatgagagcatcgtttccgtaactgatccttggttcactaatcatgttggccaagacgtcatctgaatagttttgctctttctgaagcagctcatcaacttcatcctgaatctcctcggccactgcaggcacgttgtagagcagggagagagactgattcatgcgctcataaatcacacggaggtgtgtcataacctgggaccggatctgagcggctttcttgggatccaccatgcgcacatgctcgaaatgctttagggtgtgctgtctgtccttctgttctgcgcggacatacttctttagcatattgaacacgtgacgaggccgaggaggaacagcctgcagagcggtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcttgacgttctgcctcttcccattctctcatgacctgggacattctctctcggtgcttggcctcaagcctctctttggctttctggaaatgggcatgttcattctcatccccaggtgtctcgagatacttgtcaacggcatcaggggtactggctgctgttgtaggaagtttaacaggatctcgggcaagaggttcctgggtagtcttgagtaaactttgggacatggcgctgccacacacggccatgcagtactcttctgtgtcaaagttgttccggttgccgccacatccgccgtaaaagaatggggcacacttcccttcagtcacatcaaagtaccagcgggagatcattgctcggcacggccccgtctcggcttgttcagagcacacctctcgaaccacctcttccacagactctgtggtggtggtggtggtggtggcaatgctggtggttctctctgtggcttcttcgtagggttcctcagcctcttcctctacctcatcaccatcctcatcgtcctcgtcatcatcggcttcttcttcttccacctcagccacttcttcctcctctgctacttctactactttgtcttcactcccatctgcatagtctgtgtctgctccgccccaccagacatccgagtcatcctcctccgcatcagcagaatccacattgtcactttcttcagccagtgggcaacacacaaactctacccctcggaacttgtcaattccgcagggcagcaacatgccgtagtcatgcaagttggtactcttctcactgcatgtctctttggcgacggtgtgccagtgaagatgagtttcgcaaacatccatcctctcctggtgtaagaatttgcacttgtcaggaacgagaagggcatcacttacaaactcaccaactaagcagcggtagggaatcacaaagtggggatgggtcttgcactgcttgcggccccgcttgcaccagttctggatggtcactggttggttggcttctaccacattggtgatctgcagttcagggtagacttcttggcaatactgcaggatgccttccttggtatcaatgcaggttttggtccctgatggatctgaatcccacttcccattctggacattcatgtgcatgttcagtctgccacagaacatggcaatctggggttcagccagcaggccagcattaccatcagtgggtacctccagcgcccgagccgtccaggcggccagcaggagcagtgccaaaccgggcagcatcgcgaccctgcgcggggcaccgagtgcgctgctgtgcgagtgggatccgccgcgtccttgctctgcccgcgccgccaccgccgccgtctcccggggcccccgcgcacgctcctccgcgtgctctcgcctaccgctgccgaggaaactgacggagcccgagcgcggcggcggggctcagagccaggcgagtcagctgatcc

SEQ ID NO: 17 - DNA, 3591 bp, Homo sapiens
ttttttttttttttttgctcctccaagaatgtatttatttacatgaaaacaccattttatacaaattgaagacacatcttaaaagaagggtttgtccaggcatgccttcctcatccccttatattgccacttccattttcatcttcttttgtatcataaatgaaacttcagactggttaaagaaaattgaatctgcctcttctccccacccaaaattacttcgattatttaatgtctgtagtcatccttcaaagaaaagtcttgcccggggttattttatttaatttatttatgtaatacagtgtagaaagcgatcatgtcataagcaatgattctgtacaatcatcctgcagaaaattgttttggagaattcttggtaattgaagaccagcagagcacccctccccacccgccccgtaaaagtgcttacaatgaacagggattcttttctttatcaaagacccaaagatacgtggacaaaaaaagaaaagcttgaagtctcaatgcctaatgtgtgcacataaaacaggcacgaagaaacaaacgtgtgtatcctcttaattcctatatcacaaatatagcagaagcagcaatctgtacagtaaaatgcagtcatggaaaaaaaatctctctaaagcatctgaaatacttaaaaatgtttaactttaaaatgcatagtgatcaggaaaggaatacttaggcaagagaagcagctgaactcccacgttcacatgaagcatcccccatcgattcttaaagcatatgtaaagtaggacttaattgggtcacaaaccacaagaataatatacaactggctaaggggctatgtgataaataatcaggagagaatctattcatgcactagtttgatacagctaaattctttacagtacacaaaacccattaataatgtagtatagagaccaaaatgtaaagagagatagaatacattactgatgtgtggattaattcaagttcaggcatctacttgtgttacagcacagctgtcaaaaggcgataatgagtaaatcataaaacgggtttgtttcttcccacattattctataaatggacaccgatgggtagtgaagcaatggttttgctgtccaacttcagaggctgctgtggcgggggtctagttctgcatctgctcaaagaacttgtaggttggattttcgtagccgttctgctgcatcttggacaggtggcgctcctctggggtgacagcggcgtcaacctccaccacaccatgatgaatggatgtgtactgtttcttcttcagcatcaccaaggtgatgacgatcactgtcgctatgacaacaccgcccaccatgagtccaatgattgcacctttgtttgaacccacatcttctgcaaagaacaccaatttttgatgatgaacttcatatcctgagtcatgtcggaattctgcatccatcttcacttcagagatctcctccgtcttgatatttgtcaacccagaacctggtcgagtggtcagtcctcggtcggcagcagggcgggcatcaacaggctcaacttcgttttctgtgttggctggcacagagtcagccccaaaagaatgccacggctggagatcgtccaggctgaactctccattcacgggaaggagctccacggtggttttcgtttcggtcaaagatggcatgagagcatcgtttccgtaactgatccttggttcactaatcatgttggccaagacgtcatctgaatagttttgctctttctgaagcagctcatcaacttcatcctgaatctcctcggccactgcaggcacgttgtagagcagggagagagactgattcatgcgctcataaatcacacggaggtgtgtcataacctgggaccggatctgagcggctttcttgggatccaccatgcgcacatgctcgaaatgctttagggtgtgctgtctgtccttctgttctgcgcggacatacttctttagcatattgaacacgtgacgaggccgaggaggaacagcctgcagagcggtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcttgacgttctgcctcttcccattctctcatgacctgggacattctctctcggtgcttggcctcaagcctctctttggctttctggaaatgggcatgttcattctcatccccaggtgtctcgagatacttgtcaacggcatcaggggtactggctgctgttgtaggaatggcgctgccacacacggccatgcagtactcttctgtgtcaaagttgttccggttgccgccacatccgccgtaaaagaatggggcacacttcccttcagtcacatcaaagtaccagcgggagatcattgctcggcacggccccgtctcggcttgttcagagcacacctctcgaaccacctcttccacagactctgtggtggtggtggtggtggtggcaatgctggtggttctctctgtggcttcttcgtagggttcctcagcctcttcctctacctcatcaccatcctcatcgtcctcgtcatcatcggcttcttcttcttccacctcagccacttcttcctcctctgctacttctactactttgtcttcactcccatctgcatagtctgtgtctgctccgccccaccagacatccgagtcatcctcctccgcatcagcagaatccacattgtcactttcttcagccagtgggcaacacacaaactctacccctcggaacttgtcaattccgcagggcagcaacatgccgtagtcatgcaagttggtactcttctcactgcatgtctctttggcgacggtgtgccagtgaagatgagtttcgcaaacatccatcctctcctggtgtaagaatttgcacttgtcaggaacgagaagggcatcacttacaaactcaccaactaagcagcggtagggaatcacaaagtggggatgggtcttgcactgcttgcggccccgcttgcaccagttctggatggtcactggttggttggcttctaccacattggtgatctgcagttcagggtagacttcttggcaatactgcaggatgccttccttggtatcaatgcaggttttggtccctgatggatctgaatcccacttcccattctggacattcatgtgcatgttcagtctgccacagaacatggcaatctggggttcagccagcaggccagcattaccatcagtgggtacctccagcgcccgagccgtccaggcggccagcaggagcagtgccaaaccgggcagcatcgcgaccctgcgcggggcaccgagtgcgctgctgtgcgagtgggatccgccgcgtccttgctctgcccgcgccgccaccgccgccgtctcccggggcccccgcgcacgctcctccgcgtgctctcgcctaccgctgccgaggaaactgacggagcccgagcgcggcggcggggctcagagccaggcgagtcagctgatcc

SEQ ID NO: 18 - DNA, 3572 bp, Homo sapiens
ttttttttttttttttgctcctccaagaatgtatttatttacatgaaaacaccattttatacaaattgaagacacatcttaaaagaagggtttgtccaggcatgccttcctcatccccttatattgccacttccattttcatcttcttttgtatcataaatgaaacttcagactggttaaagaaaattgaatctgcctcttctccccacccaaaattacttcgattatttaatgtctgtagtcatccttcaaagaaaagtcttgcccggggttattttatttaatttatttatgtaatacagtgtagaaagcgatcatgtcataagcaatgattctgtacaatcatcctgcagaaaattgttttggagaattcttggtaattgaagaccagcagagcacccctccccacccgccccgtaaaagtgcttacaatgaacagggattcttttctttatcaaagacccaaagatacgtggacaaaaaaagaaaagcttgaagtctcaatgcctaatgtgtgcacataaaacaggcacgaagaaacaaacgtgtgtatcctcttaattcctatatcacaaatatagcagaagcagcaatctgtacagtaaaatgcagtcatggaaaaaaaatctctctaaagcatctgaaatacttaaaaatgtttaactttaaaatgcatagtgatcaggaaaggaatacttaggcaagagaagcagctgaactcccacgttcacatgaagcatcccccatcgattcttaaagcatatgtaaagtaggacttaattgggtcacaaaccacaagaataatatacaactggctaaggggctatgtgataaataatcaggagagaatctattcatgcactagtttgatacagctaaattctttacagtacacaaaacccattaataatgtagtatagagaccaaaatgtaaagagagatagaatacattactgatgtgtggattaattcaagttcaggcatctacttgtgttacagcacagctgtcaaaaggcgataatgagtaaatcataaaacgggtttgtttcttcccacattattctataaatggacaccgatgggtagtgaagcaatggttttgctgtccaacttcagaggctgctgtggcgggggtctagttctgcatctgctcaaagaacttgtaggttggattttcgtagccgttctgctgcatcttggacaggtggcgctcctctggggtgacagcggcgtcaacctccaccacaccatgatgaatggatgtgtactgtttcttcttcagcatcaccaaggtgatgacgatcactgtcgctatgacaacaccgcccaccatgagtccaatgattgcacctttgtttgaacccacatcttctgcaaagaacaccaatttttgatgatgaacttcatatcctgagtcatgtcggaattctgcatccatcttcacttcagagatctcctccgtcttgatatttgtcaacccagaacctggtcgagtggtcagtcctcggtcggcagcagggcgggcatcaacaggctcaacttcgttttctgtgttggctggcacagagtcagccccaaaagaatgccacggctggagatcgtccaggctgaactctccattcacgggaaggagctccacggtggttttcgtttcggtcaaagatggcatgagagcatcgtttccgtaactgatccttggttcactaatcatgttggccaagacgtcatctgaatagttttgctctttctgaagcagctcatcaacttcatcctgaatctcctcggccactgcaggcacgttgtagagcagggagagagactgattcatgcgctcataaatcacacggaggtgtgtcataacctgggaccggatctgagcggctttcttgggatccaccatgcgcacatgctcgaaatgctttagggtgtgctgtctgtccttctgttctgcgcggacatacttctttagcatattgaacacgtgacgaggccgaggaggaacagcctgcagagcggtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcttgacgttctgcctcttcccattctctcatgacctgggacattctctctcggtgcttggcctcaagcctctctttggctttctggaaatgggcatgttcattctcatccccaggtgtctcgagatacttgtcaacggcatcaggggtactggctgctgttgtaggaatggcgctgccacacacggccatgcagtactcttctgtgtcaaagttgttccggttgccgccacatccgccgtaaaagaatggggcacacttcccttcagtcacatcaaagtaccagcgggagatcattgctcggcacggccccgtctcggcttgttcagagcacacctctcgaaccacctcttccacagactctgtggtggtggtggtggtggtggcaatgctggtggttctctctgtggcttcttcgtagggttcctcagcctcttcctctacctcatcaccatcctcatcgtcctcgtcatcatcggcttcttcttcttccacctcagccacttcttcctcctctgctacttctactactttgtcttcactcccatctgcatagtctgtgtctgctccgccccaccagacatccgagtcatcctcctccgcatcagcagaatccacattgtcactttcttcagccagtgggcaacacacaaactctacccctcggaacttgtcaattccgcagggcagcaacatgccgtagtcatgcaagttggtactcttctcactgcatgtctctttggcgacggtgtgccagtgaagatgagtttcgcaaacatccatcctctcctggtgtaagaatttgcacttgtcaggaacgagaagggcatcacttacaaactcaccaactaagcagcggtagggaatcacaaagtggggatgggtcttgcactgcttgcggccccgcttgcaccagttctggatggtcactggttggttggcttctaccacattggtgatctgcagttcagggtagacttcttggcaatactgcaggatgccttccttggtatcaatgcaggttttggtccctgatggatctgaatcccacttcccattctggacattcatgtgcatgttcagtctgccacagaacatggcaatctggggttcagccagcaggccagcattaccatcagtgggtacatagttgataaacagaaccaacaagtcctctaattggtccatttgaatctggggaagagctggctccaatcattgtcaattacatcagcaactgtggaatactccctgagatcaacaaactgttaactgcagtgaccacaacttgacccaggccagagcttccatcctcgggagggtgagtcaacagcatgtcaacactaacccaacttctaccacgcacagcaaggctgtgctattt

SEQ ID NO: 19 - DNA, 3255 bp, Homo sapiens
ttttttttttttttttgctcctccaagaatgtatttatttacatgaaaacaccattttatacaaattgaagacacatcttaaaagaagggtttgtccaggcatgccttcctcatccccttatattgccacttccattttcatcttcttttgtatcataaatgaaacttcagactggttaaagaaaattgaatctgcctcttctccccacccaaaattacttcgattatttaatgtctgtagtcatccttcaaagaaaagtcttgcccggggttattttatttaatttatttatgtaatacagtgtagaaagcgatcatgtcataagcaatgattctgtacaatcatcctgcagaaaattgttttggagaattcttggtaattgaagaccagcagagcacccctccccacccgccccgtaaaagtgcttacaatgaacagggattcttttctttatcaaagacccaaagatacgtggacaaaaaaagaaaagcttgaagtctcaatgcctaatgtgtgcacataaaacaggcacgaagaaacaaacgtgtgtatcctcttaattcctatatcacaaatatagcagaagcagcaatctgtacagtaaaatgcagtcatggaaaaaaaatctctctaaagcatctgaaatacttaaaaatgtttaactttaaaatgcatagtgatcaggaaaggaatacttaggcaagagaagcagctgaactcccacgttcacatgaagcatcccccatcgattcttaaagcatatgtaaagtaggacttaattgggtcacaaaccacaagaataatatacaactggctaaggggctatgtgataaataatcaggagagaatctattcatgcactagtttgatacagctaaattctttacagtacacaaaacccattaataatgtagtatagagaccaaaatgtaaagagagatagaatacattactgatgtgtggattaattcaagttcaggcatctacttgtgttacagcacagctgtcaaaaggcgataatgagtaaatcataaaacgggtttgtttcttcccacattattctataaatggacaccgatgggtagtgaagcaatggttttgctgtccaacttcagaggctgctgtggcgggggtctagttctgcatctgctcaaagaacttgtaggttggattttcgtagccgttctgctgcatcttggacaggtggcgctcctctggggtgacagcggcgtcaacctccaccacaccatgatgaatggatgtgtactgtttcttcttcagcatcaccaaggtgatgacgatcactgtcgctatgacaacaccgcccaccatgagtccaatgattgcacctttgtttgaacccacatcttctgcaaagaacaccaatttttgatgatgaacttcatatcctgagtcatgtcggaattctgcatccatcttcacttcagagatctcctccgtcttgatatttgtcaacccagaacctggtcgagtggtcagtcctcggtcggcagcagggcgggcatcaacaggctcaacttcgttttctgtgttggctggcacagagtcagccccaaaagaatgccacggctggagatcgtccaggctgaactctccattcacgggaaggagctccacggtggttttcgtttcggtcaaagatggcatgagagcatcgtttccgtaactgatccttggttcactaatcatgttggccaagacgtcatctgaatagttttgctctttctgaagcagctcatcaacttcatcctgaatctcctcggccactgcaggcacgttgtagagcagggagagagactgattcatgcgctcataaatcacacggaggtgtgtcataacctgggaccggatctgagcggctttcttgggatccaccatgcgcacatgctcgaaatgctttagggtgtgctgtctgtccttctgttctgcgcggacatacttctttagcatattgaacacgtgacgaggccgaggaggaacagcctgcagagcggtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcttgacgttctgcctcttcccattctctcatgacctgggacattctctctcggtgcttggcctcaagcctctctttggctttctggaaatgggcatgttcattctcatccccaggtgtctcgagatacttgtcaacggcatcaggggtactggctgctgttgtaggaactcgaaccacctcttccacagactctgtggtggtggtggtggtggtggcaatgctggtggttctctctgtggcttcttcgtagggttcctcagcctcttcctctacctcatcaccatcctcatcgtcctcgtcatcatcggcttcttcttcttccacctcagccacttcttcctcctctgctacttctactactttgtcttcactcccatctgcatagtctgtgtctgctccgccccaccagacatccgagtcatcctcctccgcatcagcagaatccacattgtcactttcttcagccagtgggcaacacacaaactctacccctcggaacttgtcaattccgcagggcagcaacatgccgtagtcatgcaagttggtactcttctcactgcatgtctctttggcgacggtgtgccagtgaagatgagtttcgcaaacatccatcctctcctggtgtaagaatttgcacttgtcaggaacgagaagggcatcacttacaaactcaccaactaagcagcggtagggaatcacaaagtggggatgggtcttgcactgcttgcggccccgcttgcaccagttctggatggtcactggttggttggcttctaccacattggtgatctgcagttcagggtagacctccagcgcccgagccgtccaggcggccagcaggagcagtgccaaaccgggcagcatcgcgaccctgcgcggggcaccgagtgcgctgctgtgcgagtgggatccgccgcgtccttgctctgcccgcgccgccaccgccgccgtctcccggggcccccgcgcacgctcctccgcgtgctctcgcctaccgctgccgaggaaactgacggagcccgagcgcggcggcggggctcagagccaggcgagtcagctgatcc

SEQ ID NO: 20 - DNA, 3480 bp, Homo sapiens
ttttttttttttttttgctcctccaagaatgtatttatttacatgaaaacaccattttatacaaattgaagacacatcttaaaagaagggtttgtccaggcatgccttcctcatccccttatattgccacttccattttcatcttcttttgtatcataaatgaaacttcagactggttaaagaaaattgaatctgcctcttctccccacccaaaattacttcgattatttaatgtctgtagtcatccttcaaagaaaagtcttgcccggggttattttatttaatttatttatgtaatacagtgtagaaagcgatcatgtcataagcaatgattctgtacaatcatcctgcagaaaattgttttggagaattcttggtaattgaagaccagcagagcacccctccccacccgccccgtaaaagtgcttacaatgaacagggattcttttctttatcaaagacccaaagatacgtggacaaaaaaagaaaagcttgaagtctcaatgcctaatgtgtgcacataaaacaggcacgaagaaacaaacgtgtgtatcctcttaattcctatatcacaaatatagcagaagcagcaatctgtacagtaaaatgcagtcatggaaaaaaaatctctctaaagcatctgaaatacttaaaaatgtttaactttaaaatgcatagtgatcaggaaaggaatacttaggcaagagaagcagctgaactcccacgttcacatgaagcatcccccatcgattcttaaagcatatgtaaagtaggacttaattgggtcacaaaccacaagaataatatacaactggctaaggggctatgtgataaataatcaggagagaatctattcatgcactagtttgatacagctaaattctttacagtacacaaaacccattaataatgtagtatagagaccaaaatgtaaagagagatagaatacattactgatgtgtggattaattcaagttcaggcatctacttgtgttacagcacagctgtcaaaaggcgataatgagtaaatcataaaacgggtttgtttcttcccacattattctataaatggacaccgatgggtagtgaagcaatggttttgctgtccaacttcagaggctgctgtggcgggggtctagttctgcatctgctcaaagaacttgtaggttggattttcgtagccgttctgctgcatcttggacaggtggcgctcctctggggtgacagcggcgtcaacctccaccacaccatgatgaatggatgtgtactgtttcttcttcagcatcaccaaggtgatgacgatcactgtcgctatgacaacaccgcccaccatgagtccaatgattgcacctttgtttgaacccacatcttctgcaaagaacaccaatttttgatgatgaacttcatatcctgagtcatgtcggaattctgcatccatcttcacttcagagatctcctccgtcttgatatttgtcaacccagaacctggtcgagtggtcagtcctcggtcggcagcagggcgggcatcaacaggctcaacttcgttttctgtgttggctggcacagagtcagccccaaaagaatgccacggctggagatcgtccaggctgaactctccattcacgggaaggagctccacggtggttttcgtttcggtcaaagatggcatgagagcatcgtttccgtaactgatccttggttcactaatcatgttggccaagacgtcatctgaatagttttgctctttctgaagcagctcatcaacttcatcctgaatctcctcggccactgcaggcacgttgtagagcagggagagagactgattcatgcgctcataaatcacacggaggtgtgtcataacctgggaccggatctgagcggctttcttgggatccaccatgcgcacatgctcgaaatgctttagggtgtgctgtctgtccttctgttctgcgcggacatacttctttagcatattgaacacgtgacgaggccgaggaggaacagcctgcagagcggtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcttgacgttctgcctcttcccattctctcatgacctgggacattctctctcggtgcttggcctcaagcctctctttggctttctggaaatgggcatgttcattctcatccccaggtgtctcgagatacttgtcaacggcatcaggggtactggctgctgttgtaggaagtttaacaggatctcgggcaagaggttcctgggtagtcttgagtaaactttgggacatggcgctgccacacacggccatgcagtactcttctgtgtcaaagttgttccggttgccgccacatccgccgtaaaagaatggggcacacttcccttcagtcacatcaaagtaccagcgggagatcattgctcggcacggccccgtctcggcttgttcagagcacacctctcgaaccacctcttccacagactctgtggtggtggtggtggtggtggcaatgctggtggttctctctgtggcttcttcgtagggttcctcagcctcttcctctacctcatcaccatcctcatcgtcctcgtcatcatcggcttcttcttcttccacctcagccacttcttcctcctctgctacttctactactttgtcttcactcccatctgcatagtctgtgtctgctccgccccaccagacatccgagtcatcctcctccgcatcagcagaatccacattgtcactttcttcagccagtgggcaacacacaaactctacccctcggaacttgtcaattccgcagggcagcaacatgccgtagtcatgcaagttggtactcttctcactgcatgtctctttggcgacggtgtgccagtgaagatgagtttcgcaaacatccatcctctcctggtgtaagaatttgcacttgtcaggaacgagaagggcatcacttacaaactcaccaactaagcagcggtagggaatcacaaagtggggatgggtcttgcactgcttgcggccccgcttgcaccagttctggatggtcactggttggttggcttctaccacattggtgatctgcagttcagggtagacctccagcgcccgagccgtccaggcggccagcaggagcagtgccaaaccgggcagcatcgcgaccctgcgcggggcaccgagtgcgctgctgtgcgagtgggatccgccgcgtccttgctctgcccgcgccgccaccgccgccgtctcccggggcccccgcgcacgctcctccgcgtgctctcgcctaccgctgccgaggaaactgacggagcccgagcgcggcggcggggctcagagccaggcgagtcagctgatcc

SEQ ID NO: 21 - DNA, 3310 bp, Homo sapiens
ttttttttttttttttgctcctccaagaatgtatttatttacatgaaaacaccattttatacaaattgaagacacatcttaaaagaagggtttgtccaggcatgccttcctcatccccttatattgccacttccattttcatcttcttttgtatcataaatgaaacttcagactggttaaagaaaattgaatctgcctcttctccccacccaaaattacttcgattatttaatgtctgtagtcatccttcaaagaaaagtcttgcccggggttattttatttaatttatttatgtaatacagtgtagaaagcgatcatgtcataagcaatgattctgtacaatcatcctgcagaaaattgttttggagaattcttggtaattgaagaccagcagagcacccctccccacccgccccgtaaaagtgcttacaatgaacagggattcttttctttatcaaagacccaaagatacgtggacaaaaaaagaaaagcttgaagtctcaatgcctaatgtgtgcacataaaacaggcacgaagaaacaaacgtgtgtatcctcttaattcctatatcacaaatatagcagaagcagcaatctgtacagtaaaatgcagtcatggaaaaaaaatctctctaaagcatctgaaatacttaaaaatgtttaactttaaaatgcatagtgatcaggaaaggaatacttaggcaagagaagcagctgaactcccacgttcacatgaagcatcccccatcgattcttaaagcatatgtaaagtaggacttaattgggtcacaaaccacaagaataatatacaactggctaaggggctatgtgataaataatcaggagagaatctattcatgcactagtttgatacagctaaattctttacagtacacaaaacccattaataatgtagtatagagaccaaaatgtaaagagagatagaatacattactgatgtgtggattaattcaagttcaggcatctacttgtgttacagcacagctgtcaaaaggcgataatgagtaaatcataaaacgggtttgtttcttcccacattattctataaatggacaccgatgggtagtgaagcaatggttttgctgtccaacttcagaggctgctgtggcgggggtctagttctgcatctgctcaaagaacttgtaggttggattttcgtagccgttctgctgcatcttggacaggtggcgctcctctggggtgacagcggcgtcaacctccaccacaccatgatgaatggatgtgtactgtttcttcttcagcatcaccaaggtgatgacgatcactgtcgctatgacaacaccgcccaccatgagtccaatgattgcacctttgtttgaacccacatcttctgcaaagaacaccaatttttgatgatgaacttcatatcctgagtcatgtcggaattctgcatccatcttcacttcagagatctcctccgtcttgatatttgtcaacccagaacctggtcgagtggtcagtcctcggtcggcagcagggcgggcatcaacaggctcaacttcgttttctgtgttggctggcacagagtcagccccaaaagaatgccacggctggagatcgtccaggctgaactctccattcacgggaaggagctccacggtggttttcgtttcggtcaaagatggcatgagagcatcgtttccgtaactgatccttggttcactaatcatgttggccaagacgtcatctgaatagttttgctctttctgaagcagctcatcaacttcatcctgaatctcctcggccactgcaggcacgttgtagagcagggagagagactgattcatgcgctcataaatcacacggaggtgtgtcataacctgggaccggatctgagcggctttcttgggatccaccatgcgcacatgctcgaaatgctttagggtgtgctgtctgtccttctgttctgcgcggacatacttctttagcatattgaacacgtgacgaggccgaggaggaacagcctgcagagcggtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcttgacgttctgcctcttcccattctctcatgacctgggacattctctctcggtgcttggcctcaagcctctctttggctttctggaaatgggcatgttcattctcatccccaggtgtctcgagatacttgtcaacggcatcaggggtactggctgctgttgtaggaactcgaaccacctcttccacagactctgtggtggtggtggtggtggtggcaatgctggtggttctctctgtggcttcttcgtagggttcctcagcctcttcctctacctcatcaccatcctcatcgtcctcgtcatcatcggcttcttcttcttccacctcagccacttcttcctcctctgctacttctactactttgtcttcactcccatctgcatagtctgtgtctgctccgccccaccagacatccgagtcatcctcctccgcatcagcagaatccacattgtcactttcttcagccagtgggcaacacacaaactctacccctcggaacttgtcaattccgcagggcagcaacatgccgtagtcatgcaagttggtactcttctcactgcatgtctctttggcgacggtgtgccagtgaagatgagtttcgcaaacatccatcctctcctggtgtaagaatttgcacttgtcaggaacgagaagggcatcacttacaaactcaccaactaagcagcggtagggaatcacaaagtggggatgggtcttgcactgcttgcggccccgcttgcaccagttctggatggtcactggttggttggcttctaccacattggtgatctgcagttcagggtagacttcttggcaatactgcaggatgccttccttggtatcaatgcaggttttggtccctgatggatctgaatcccacttcccattctggacattcatgtgcatgttcagtctgccacagaacatggcaatctggggttcagccagcaggccagcattaccatcagtgggtacctgggcttcgtgaacagtgggagggagagtctggggccaggagagggacggtgcaggatcagggaaaggtgagtcctaggacgctgaggctctagaaaagtcgagagcgctcctgctcgtccccgtgagcttgaatcatccgac

SEQ ID NO: 22 - DNA, 3594 bp, Homo sapiens
ttttttttttttttttgctcctccaagaatgtatttatttacatgaaaacaccattttatacaaattgaagacacatcttaaaagaagggtttgtccaggcatgccttcctcatccccttatattgccacttccattttcatcttcttttgtatcataaatgaaacttcagactggttaaagaaaattgaatctgcctcttctccccacccaaaattacttcgattatttaatgtctgtagtcatccttcaaagaaaagtcttgcccggggttattttatttaatttatttatgtaatacagtgtagaaagcgatcatgtcataagcaatgattctgtacaatcatcctgcagaaaattgttttggagaattcttggtaattgaagaccagcagagcacccctccccacccgccccgtaaaagtgcttacaatgaacagggattcttttctttatcaaagacccaaagatacgtggacaaaaaaagaaaagcttgaagtctcaatgcctaatgtgtgcacataaaacaggcacgaagaaacaaacgtgtgtatcctcttaattcctatatcacaaatatagcagaagcagcaatctgtacagtaaaatgcagtcatggaaaaaaaatctctctaaagcatctgaaatacttaaaaatgtttaactttaaaatgcatagtgatcaggaaaggaatacttaggcaagagaagcagctgaactcccacgttcacatgaagcatcccccatcgattcttaaagcatatgtaaagtaggacttaattgggtcacaaaccacaagaataatatacaactggctaaggggctatgtgataaataatcaggagagaatctattcatgcactagtttgatacagctaaattctttacagtacacaaaacccattaataatgtagtatagagaccaaaatgtaaagagagatagaatacattactgatgtgtggattaattcaagttcaggcatctacttgtgttacagcacagctgtcaaaaggcgataatgagtaaatcataaaacgggtttgtttcttcccacattattctataaatggacaccgatgggtagtgaagcaatggttttgctgtccaacttcagaggctgctgtggcgggggtctagttctgcatctgctcaaagaacttgtaggttggattttcgtagccgttctgctgcatcttggacaggtggcgctcctctggggtgacagcggcgtcaacctccaccacaccatgatgaatggatgtgtactgtttcttcttcagcatcaccaaggtgatgacgatcactgtcgctatgacaacaccgcccaccatgagtccaatgattgcacctttgtttgaacccacatcttctgcaaagaacaccaatttttgatgatgaacttcatatcctgagtcatgtcggaattctgcatccatcttcacttcagagatctcctccgtcttgatatttgtcaacccagaaccttcgttttctgtgttggctggcacagagtcagccccaaaagaatgccacggctggagatcgtccaggctgaactctccattcacgggaaggagctccacggtggttttcgtttcggtcaaagatggcatgagagcatcgtttccgtaactgatccttggttcactaatcatgttggccaagacgtcatctgaatagttttgctctttctgaagcagctcatcaacttcatcctgaatctcctcggccactgcaggcacgttgtagagcagggagagagactgattcatgcgctcataaatcacacggaggtgtgtcataacctgggaccggatctgagcggctttcttgggatccaccatgcgcacatgctcgaaatgctttagggtgtgctgtctgtccttctgttctgcgcggacatacttctttagcatattgaacacgtgacgaggccgaggaggaacagcctgcagagcggtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcttgacgttctgcctcttcccattctctcatgacctgggacattctctctcggtgcttggcctcaagcctctctttggctttctggaaatgggcatgttcattctcatccccaggtgtctcgagatacttgtcaacggcatcaggggtactggctgctgttgtaggaagtttaacaggatctcgggcaagaggttcctgggtagtcttgagtaaactttgggacatggcgctgccacacacggccatgcagtactcttctgtgtcaaagttgttccggttgccgccacatccgccgtaaaagaatggggcacacttcccttcagtcacatcaaagtaccagcgggagatcattgctcggcacggccccgtctcggcttgttcagagcacacctctcgaaccacctcttccacagactctgtggtggtggtggtggtggtggcaatgctggtggttctctctgtggcttcttcgtagggttcctcagcctcttcctctacctcatcaccatcctcatcgtcctcgtcatcatcggcttcttcttcttccacctcagccacttcttcctcctctgctacttctactactttgtcttcactcccatctgcatagtctgtgtctgctccgccccaccagacatccgagtcatcctcctccgcatcagcagaatccacattgtcactttcttcagccagtgggcaacacacaaactctacccctcggaacttgtcaattccgcagggcagcaacatgccgtagtcatgcaagttggtactcttctcactgcatgtctctttggcgacggtgtgccagtgaagatgagtttcgcaaacatccatcctctcctggtgtaagaatttgcacttgtcaggaacgagaagggcatcacttacaaactcaccaactaagcagcggtagggaatcacaaagtggggatgggtcttgcactgcttgcggccccgcttgcaccagttctggatggtcactggttggttggcttctaccacattggtgatctgcagttcagggtagacttcttggcaatactgcaggatgccttccttggtatcaatgcaggttttggtccctgatggatctgaatcccacttcccattctggacattcatgtgcatgttcagtctgccacagaacatggcaatctggggttcagccagcaggccagcattaccatcagtgggtacctccagcgcccgagccgtccaggcggccagcaggagcagtgccaaaccgggcagcatcgcgaccctgcgcggggcaccgagtgcgctgctgtgcgagtgggatccgccgcgtccttgctctgcccgcgccgccaccgccgccgtctcccggggcccccgcgcacgctcctccgcgtgctctcgcctaccgctgccgaggaaactgacggagcccgagcgcggcggcggggctcagagccaggcgagtcagctgatcc

SEQ ID NO: 23 - DNA, 3537 bp, Homo sapiens
ttttttttttttttttgctcctccaagaatgtatttatttacatgaaaacaccattttatacaaattgaagacacatcttaaaagaagggtttgtccaggcatgccttcctcatccccttatattgccacttccattttcatcttcttttgtatcataaatgaaacttcagactggttaaagaaaattgaatctgcctcttctccccacccaaaattacttcgattatttaatgtctgtagtcatccttcaaagaaaagtcttgcccggggttattttatttaatttatttatgtaatacagtgtagaaagcgatcatgtcataagcaatgattctgtacaatcatcctgcagaaaattgttttggagaattcttggtaattgaagaccagcagagcacccctccccacccgccccgtaaaagtgcttacaatgaacagggattcttttctttatcaaagacccaaagatacgtggacaaaaaaagaaaagcttgaagtctcaatgcctaatgtgtgcacataaaacaggcacgaagaaacaaacgtgtgtatcctcttaattcctatatcacaaatatagcagaagcagcaatctgtacagtaaaatgcagtcatggaaaaaaaatctctctaaagcatctgaaatacttaaaaatgtttaactttaaaatgcatagtgatcaggaaaggaatacttaggcaagagaagcagctgaactcccacgttcacatgaagcatcccccatcgattcttaaagcatatgtaaagtaggacttaattgggtcacaaaccacaagaataatatacaactggctaaggggctatgtgataaataatcaggagagaatctattcatgcactagtttgatacagctaaattctttacagtacacaaaacccattaataatgtagtatagagaccaaaatgtaaagagagatagaatacattactgatgtgtggattaattcaagttcaggcatctacttgtgttacagcacagctgtcaaaaggcgataatgagtaaatcataaaacgggtttgtttcttcccacattattctataaatggacaccgatgggtagtgaagcaatggttttgctgtccaacttcagaggctgctgtggcgggggtctagttctgcatctgctcaaagaacttgtaggttggattttcgtagccgttctgctgcatcttggacaggtggcgctcctctggggtgacagcggcgtcaacctccaccacaccatgatgaatggatgtgtactgtttcttcttcagcatcaccaaggtgatgacgatcactgtcgctatgacaacaccgcccaccatgagtccaatgattgcacctttgtttgaacccacatcttctgcaaagaacaccaatttttgatgatgaacttcatatcctgagtcatgtcggaattctgcatccatcttcacttcagagatctcctccgtcttgatatttgtcaacccagaaccttcgttttctgtgttggctggcacagagtcagccccaaaagaatgccacggctggagatcgtccaggctgaactctccattcacgggaaggagctccacggtggttttcgtttcggtcaaagatggcatgagagcatcgtttccgtaactgatccttggttcactaatcatgttggccaagacgtcatctgaatagttttgctctttctgaagcagctcatcaacttcatcctgaatctcctcggccactgcaggcacgttgtagagcagggagagagactgattcatgcgctcataaatcacacggaggtgtgtcataacctgggaccggatctgagcggctttcttgggatccaccatgcgcacatgctcgaaatgctttagggtgtgctgtctgtccttctgttctgcgcggacatacttctttagcatattgaacacgtgacgaggccgaggaggaacagcctgcagagcggtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcttgacgttctgcctcttcccattctctcatgacctgggacattctctctcggtgcttggcctcaagcctctctttggctttctggaaatgggcatgttcattctcatccccaggtgtctcgagatacttgtcaacggcatcaggggtactggctgctgttgtaggaatggcgctgccacacacggccatgcagtactcttctgtgtcaaagttgttccggttgccgccacatccgccgtaaaagaatggggcacacttcccttcagtcacatcaaagtaccagcgggagatcattgctcggcacggccccgtctcggcttgttcagagcacacctctcgaaccacctcttccacagactctgtggtggtggtggtggtggtggcaatgctggtggttctctctgtggcttcttcgtagggttcctcagcctcttcctctacctcatcaccatcctcatcgtcctcgtcatcatcggcttcttcttcttccacctcagccacttcttcctcctctgctacttctactactttgtcttcactcccatctgcatagtctgtgtctgctccgccccaccagacatccgagtcatcctcctccgcatcagcagaatccacattgtcactttcttcagccagtgggcaacacacaaactctacccctcggaacttgtcaattccgcagggcagcaacatgccgtagtcatgcaagttggtactcttctcactgcatgtctctttggcgacggtgtgccagtgaagatgagtttcgcaaacatccatcctctcctggtgtaagaatttgcacttgtcaggaacgagaagggcatcacttacaaactcaccaactaagcagcggtagggaatcacaaagtggggatgggtcttgcactgcttgcggccccgcttgcaccagttctggatggtcactggttggttggcttctaccacattggtgatctgcagttcagggtagacttcttggcaatactgcaggatgccttccttggtatcaatgcaggttttggtccctgatggatctgaatcccacttcccattctggacattcatgtgcatgttcagtctgccacagaacatggcaatctggggttcagccagcaggccagcattaccatcagtgggtacctccagcgcccgagccgtccaggcggccagcaggagcagtgccaaaccgggcagcatcgcgaccctgcgcggggcaccgagtgcgctgctgtgcgagtgggatccgccgcgtccttgctctgcccgcgccgccaccgccgccgtctcccggggcccccgcgcacgctcctccgcgtgctctcgcctaccgctgccgaggaaactgacggagcccgagcgcggcggcggggctcagagccaggcgagtcagctgatcc

SEQ ID NO: 24 - DNA, 3369 bp, Homo sapiens
ttttttttttttttttgctcctccaagaatgtatttatttacatgaaaacaccattttatacaaattgaagacacatcttaaaagaagggtttgtccaggcatgccttcctcatccccttatattgccacttccattttcatcttcttttgtatcataaatgaaacttcagactggttaaagaaaattgaatctgcctcttctccccacccaaaattacttcgattatttaatgtctgtagtcatccttcaaagaaaagtcttgcccggggttattttatttaatttatttatgtaatacagtgtagaaagcgatcatgtcataagcaatgattctgtacaatcatcctgcagaaaattgttttggagaattcttggtaattgaagaccagcagagcacccctccccacccgccccgtaaaagtgcttacaatgaacagggattcttttctttatcaaagacccaaagatacgtggacaaaaaaagaaaagcttgaagtctcaatgcctaatgtgtgcacataaaacaggcacgaagaaacaaacgtgtgtatcctcttaattcctatatcacaaatatagcagaagcagcaatctgtacagtaaaatgcagtcatggaaaaaaaatctctctaaagcatctgaaatacttaaaaatgtttaactttaaaatgcatagtgatcaggaaaggaatacttaggcaagagaagcagctgaactcccacgttcacatgaagcatcccccatcgattcttaaagcatatgtaaagtaggacttaattgggtcacaaaccacaagaataatatacaactggctaaggggctatgtgataaataatcaggagagaatctattcatgcactagtttgatacagctaaattctttacagtacacaaaacccattaataatgtagtatagagaccaaaatgtaaagagagatagaatacattactgatgtgtggattaattcaagttcaggcatctacttgtgttacagcacagctgtcaaaaggcgataatgagtaaatcataaaacgggtttgtttcttcccacattattctataaatggacaccgatgggtagtgaagcaatggttttgctgtccaacttcagaggctgctgtggcgggggtctagttctgcatctgctcaaagaacttgtaggttggattttcgtagccgttctgctgcatcttggacaggtggcgctcctctggggtgacagcggcgtcaacctccaccacaccatgatgaatggatgtgtactgtttcttcttcagcatcaccaaggtgatgacgatcactgtcgctatgacaacaccgcccaccatgagtccaatgattgcacctttgtttgaacccacatcttctgcaaagaacaccaatttttgatgatgaacttcatatcctgagtcatgtcggaattctgcatccatcttcacttcagagatctcctccgtcttgatatttgtcaacccagaaccttcgttttctgtgttggctggcacagagtcagccccaaaagaatgccacggctggagatcgtccaggctgaactctccattcacgggaaggagctccacggtggttttcgtttcggtcaaagatggcatgagagcatcgtttccgtaactgatccttggttcactaatcatgttggccaagacgtcatctgaatagttttgctctttctgaagcagctcatcaacttcatcctgaatctcctcggccactgcaggcacgttgtagagcagggagagagactgattcatgcgctcataaatcacacggaggtgtgtcataacctgggaccggatctgagcggctttcttgggatccaccatgcgcacatgctcgaaatgctttagggtgtgctgtctgtccttctgttctgcgcggacatacttctttagcatattgaacacgtgacgaggccgaggaggaacagcctgcagagcggtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcttgacgttctgcctcttcccattctctcatgacctgggacattctctctcggtgcttggcctcaagcctctctttggctttctggaaatgggcatgttcattctcatccccaggtgtctcgagatacttgtcaacggcatcaggggtactggctgctgttgtaggaactcgaaccacctcttccacagactctgtggtggtggtggtggtggtggcaatgctggtggttctctctgtggcttcttcgtagggttcctcagcctcttcctctacctcatcaccatcctcatcgtcctcgtcatcatcggcttcttcttcttccacctcagccacttcttcctcctctgctacttctactactttgtcttcactcccatctgcatagtctgtgtctgctccgccccaccagacatccgagtcatcctcctccgcatcagcagaatccacattgtcactttcttcagccagtgggcaacacacaaactctacccctcggaacttgtcaattccgcagggcagcaacatgccgtagtcatgcaagttggtactcttctcactgcatgtctctttggcgacggtgtgccagtgaagatgagtttcgcaaacatccatcctctcctggtgtaagaatttgcacttgtcaggaacgagaagggcatcacttacaaactcaccaactaagcagcggtagggaatcacaaagtggggatgggtcttgcactgcttgcggccccgcttgcaccagttctggatggtcactggttggttggcttctaccacattggtgatctgcagttcagggtagacttcttggcaatactgcaggatgccttccttggtatcaatgcaggttttggtccctgatggatctgaatcccacttcccattctggacattcatgtgcatgttcagtctgccacagaacatggcaatctggggttcagccagcaggccagcattaccatcagtgggtacctccagcgcccgagccgtccaggcggccagcaggagcagtgccaaaccgggcagcatcgcgaccctgcgcggggcaccgagtgcgctgctgtgcgagtgggatccgccgcgtccttgctctgcccgcgccgccaccgccgccgtctcccggggcccccgcgcacgctcctccgcgtgctctcgcctaccgctgccgaggaaactgacggagcccgagcgcggcggcggggctcagagccaggcgagtcagctgatcc

SEQ ID NO: 25 - DNA, 1795 bp, Homo sapiens
gaacagcttacttaccaacttcatcctgaatctcctcggccactgcaggcacgttgtagagcagggagagagactgattcatgcgctcataaatcacacggaggtgtgtcataacctgggaccggatctgagcggctttcttgggatccaccatgcgcacatgctcgaaatgctttagggtgtgctgtctgtccttctgttctgcgcggacatacttctttagcatattgaacacgtgacgaggccgaggaggaacagcctgcagagcggtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcttgacgttctgcctcttcccattctctcatgacctgggacattctctctcggtgcttggcctcaagcctctctttggctttctggaaatgggcatgttcattctcatccccaggtgtctcgagatacttgtcaacggcatcaggggtactggctgctgttgtaggaatggcgctgccacacacggccatgcagtactcttctgtgtcaaagttgttccggttgccgccacatccgccgtaaaagaatggggcacacttcccttcagtcacatcaaagtaccagcgggagatcattgctcggcacggccccgtctcggcttgttcagagcacacctctcgaaccacctcttccacagactctgtggtggtggtggtggtggtggcaatgctggtggttctctctgtggcttcttcgtagggttcctcagcctcttcctctacctcatcaccatcctcatcgtcctcgtcatcatcggcttcttcttcttccacctcagccacttcttcctcctctgctacttctactactttgtcttcactcccatctgcatagtctgtgtctgctccgccccaccagacatccgagtcatcctcctccgcatcagcagaatccacattgtcactttcttcagccagtgggcaacacacaaactctacccctcggaacttgtcaattccgcagggcagcaacatgccgtagtcatgcaagttggtactcttctcactgcatgtctctttggcgacggtgtgccagtgaagatgagtttcgcaaacatccatcctctcctggtgtaagaatttgcacttgtcaggaacgagaagggcatcacttacaaactcaccaactaagcagcggtagggaatcacaaagtggggatgggtcttgcactgcttgcggccccgcttgcaccagttctggatggtcactggttggttggcttctaccacattggtgatctgcagttcagggtagacttcttggcaatactgcaggatgccttccttggtatcaatgcaggttttggtccctgatggatctgaatcccacttcccattctggacattcatgtgcatgttcagtctgccacagaacatggcaatctggggttcagccagcaggccagcattaccatcagtgggtacctccagcgcccgagccgtccaggcggccagcaggagcagtgccaaaccgggcagcatcgcgaccctgcgcggggcaccgagtgcgctgctgtgcgagtgggatccgccgcgtccttgctctgcccgcgccgccaccgccgccgtctcccggggcccccgcgcacgctcctccgcgtgctctcgcctaccgctgccgaggaaactgac

SEQ ID NO: 26 - DNA, 3926 bp, Macaca fascicularis
tgctcctccaagaatgtatttatttacatgaaaacaccattttatacaaattgaagacacatcttaaagaagggtttgtccaggcatgccttcctccttcccttatattgccacttccattttcatcttctgttgtatcataaataaaacttcagactggttaaagaaaattgaatctgcctcttctctccccgcccagaattactttgactgtttaatgtctggagtcatccttcaaagaaaagtcttgcccagggttattttatttaatttatttatgtaatacagtgtagaaagcgatcatgtcataagcaatgattctgtacaatcatcctgcagaaatattttttggagaattcttggtaatttaagaccagcagagcacccctccccacccgccccgtaaaagtgcttacaatgaacagggattcttttctttatcaaagacccaaagatacgtggacaaaaaaaaaagctcgaagtctcaatgcctaatgtgtgcacataaaacaggcacaaagaaacaaacgtgtatcctcttaattcctatatcacaaatatagcagaagcagcaatctgtacagtaaaatgcaatcgtggaaaaaaaatctctctaaagcatctgaagtacttaaaaatgtttaactttaaaatgcatagtgatcaggaaaggaatacttaggcaagagaagcagctaaactcccacgttcacatgaagcatcccccatcgattcttaaagcatatgtaaagtaggacttaattgggtcacaaaccacaagaataatatacaactggctaaggggctatgtgataaataatcaggagagaatctattcatgcactagtttgatacagctaaattctttacagtacacaaaacccattaataatgtagtgtagagaccaaaatgtaaagagagagagaatacattactgatttgtggattaattcaagttcaggcatctacttgtgttacagcacagctgtcaaaaggcgataatgagtaaatcataaaacagaggggtttgtttcttccgacagtattctataaatggacaccgatgggtagtgaagcaatggttttgctgtccaacttcagaggctgctgtggcgggggtctagttctgcatctgctcaaagaacttgtaggttggattttcatagccgttctgctgcatcttggacaggtggcgctcctctggggtgacagcggcgtcaacctccaccacaccatgatgaatggacgtgtactgtttcttcttcagcatcaccaaggtgatgacgatcactgttgctatgacaacaccgcccaccatgagaccaatgattgcacctttgtttgaacccacatcttcggcaaagaacaccaatttttgatgatgaacttcataacctgagtcatgtcggaattctgcatccatcttcacttcagagatctcctctgtcttgatatttgtcaacccagaacctggtcgagtggtcagtcctcggtcggcagcagggcgggcatcaacaggctcaacttcgttttctgtgttggctggcacagagtcagccccgaaagaatgccacggctgaagatcgtccaggctgaactctccattcacgggaagaagctccacggtagttttcgtttcggtcaaagacggcatgagagcatcgtttccgtaactgatccttggttcactaatcatgttggccaagacgtcatctgaatagttttgctctttctgaagcagctcatcaacttcatcctgaatctcctcggccactgcaggcacgttgtagagcagggagagggactgattcatgcgctcgtaaatcacacggaggtgtgtcataacctgggaccggatctgagcagctttcttgggatccaccatgcgtacatgctcgaaatgcttcagggtgtgctgtctgtccttctgttctgcgcggacgtacttcttcagcatattgaacacgtgacgaggccgaggaggaacggcctgcagagcagtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcctgacgttctgcctcttcccattctctcatgacctgggacattctctctcggtgcttggcctcaagtctctctttggctttctggaaatgggcgtgttcattctcatccccaggtgtctcaaggtacttgtcaacggcatcaggggtactggctgctgttgtaggaagtttaacaggatctcgggtaagaggttcccgggtagtcttgcgtaaactttgggacatgacgctgccacacacggccatgcagtactcttctgtgtcaaagttgttccggttgccgccacatccgccgtaaaagaatggggcacacttcccttcagtcacatcaaagtaccagcgggagatcattgctcggcatggccccgtctcggcttgttcagagcacacctctcgaaccacctcttccacagactccgtggtggtggtggtggtggtggcgatgctggtggttctctctgtggcttcttcgtagggttcctcagcctcttcctctacctcatcaccatcctcatcgtcctcgtcatcatcggcttcttcttcttccacctcggccacttcttcctcctctgctacttctactactttgtcttcactcccgtctgcatagtctgtgtctgctccgccccaccagacatccgagtcatcctcctccgcatcagcagaatccacattgtcactttcctcagccagtgggcaacacacaaactctacccctcggaacttatcgattccgcagggcagcaacatgccgtagtcatgcaagttggtgctcttctcactgcacgtctctttggcgacggtgtgccagtgaagatgagtttcgcaaacatccatcctctcctggtgtaagaatttgcacttgtcaggaacgagaagggcatcgcttacaaactcaccaactaaacagcggtagggaatcacaaagtggggatgggtcttgcactgcttgcggccccgcttgcaccagttctggatggtcactggttggttggcttctaccacattggtgatctgcagttcagggtagacttcttggcaatactgcaggatgccttccttggtatcaatgcaggttttggtccctgatggatctgaatcccacttcccattctggacattcatgtgcatgttcagtctgccacagaacatggcgatctggggttcagccagcaggccagcattgccatcagtaggtacctccagcgcccgagccgtccaggcggccagcaggagcagtgccaaaccgggcagcatcgcgaccctgcgcggggcaccgagtgcgctgctgtgcgagtgggatccgccgcgtccttgctctgcccgcgccaccgccgccgtctccgggggcccccgcgcgcgctgctccgagtgctctcgcctaccgctgccgaggaaactgacggagcaggagcgcggcggcgaggctcggagccaggcaagtcagctgatccggcccaccccgctcggcactcgagagagacccctagcggcgccgccggggagctgcgcccgctcgcgccgggaggggcccgcgcgccccgggcccacaggtgcagcgccctaggcgccgcctgcaccacacgcgccctcctcagctccccggcagacagcccacctgggcttcgggaacagtgggagggagagtctggggccaggagagggacggtgcaggatcagggaaaggtgagtcctaggacgctggggctctagaaaagtcgggagcgctcccgctcgtccccgtgagct

SEQ ID NO: 27 - DNA, 3377 bp, Mus musculus
tttttttttttttttttttttcttgcctggagttattttatttaatttatttatgtaatacagtgtagaaagctatcatggcataagcaatgattctgtacaatcatcctgcagaaaattaatttttggagaattcttggtaattggagaccagcagaacactccctccccccacccgtaaaagtgcttatgatgaacagggataatttttttttaatttttttttatcaaagatccaaagatacatggacaaaaaaaatgttcaaattctcaatgcctaatgtgtgcacataaaacaggcacaaagaaatcaatgtgtatcctcttattcctatatcacaaagagagcagaagcagcaatctgtacagtaagatgcagtcatggaaaaagaattttctaagtcatttggaatacttaaaaaaatgttcaaaatgcatagtgatcaggaaaagaatacgtaggagaagcagctagacgcccacgttcacaagaagcatcccccatcgatttttaaagcatatttcaagtaggagttttttccgggccacaaaccacaagaataatatacaacgggctaaggggctatgtatgtgataaataattaggagagaatctattcatgcactagtttgatacagctaatttttttttttacagtacacaaaacccatgaatcatgtaatgtagagaccagaatgtaaagagagaaagcgagaatacattactgatttgtatattaattcaagttcaggcatctacttgtgttacagcacagctgtcaaaagccgagggtgagtaaataaacggaagggtttgtttctttccacgttattttataaatgaacaccgatgggtagtgaagcaatggtttcgctgtccaagttcagaggccgctgctgtggcgcgggtggggcttagttctgcatttgctcaaagaacttgtaagttggattctcatatccgttctgctgcatcttggagagatggcgctcctctggggtcacggcggcgtcgacctccaccacgccatgatggatggatgtgtactgtttcttcttcaacatcaccagggtgatgacaatcacggttgctatgacaacgccgcccaccatgagtccgatgatggcgcctttgttcgaacccacatcttcagcaaagaacaccagtttttgatggcggacttcaaatcctgaatcatgtccgaattctgcatccatcttcacttccgagatctcttccgtcttgatgtttgtcagcccagaacctggtcgagtggtcagtcctcggtcagcagcggggcgggcgtcaacaggctcgacttcattttcggtattggctggcacagagtccaccccaaaagggtgccacggctggaggtcatccaggctgaattccccattcacgggaaggagctccacggtggtcttggtttccgtcagcgaaggcatgagagcgtcgtttccgtagctgattctgggctcactgatcatgttggccaagacatcgtcggagtagttctgctccttctgaagcagctcatcgacttcatcttgaatctcctcagccaccgcagggacattgtagagcagggacagagactggttcatgcgctcgtagatcacacggaggtgtgtcataacctgggaccggatctgagcagctttcttggggtccaccatgcgcacatgttcaaaatgctttagggtgtgctgtctgtctttctgctccgcacggacgtacttcttcagcatgttgaacacatgatgaggccttgggggcaccgcctgcagtgcagtgatgtaattctcgagggccaggcggcggcggtcattgagcatggcttcaactctggccatgtgtgtctctacaagctgctgtctctcattggctgcttcctgttccagagattccactttctcctggaaatgctggataacggccttcttgtcagctttgggcaagttcttggcttgacgctctgcctcttcccattctctcatgacctgggacattctctctcggtgcttggcttccagcctctctttggctttctggaaatgggcatgctcgttctcgtccccgggtgtctccaggtacttgtcgacggcgtcgggggtgctggctgctgtcgtgggaagtttatcaggatcttggggaagaggttcactggtagtcttgagtaaactttgggttgacacgctgccacacaccgccatgcagtactcttccgtgtcaaagttgttcctgttgccgccacatccgccgtaaaagaatgggacacacttcccttcagtgacatcaaagtaccagcgggagatcattgcgcggcatggcccggtctcggcttgttcagagcacacctctcggaccacctcctccacggactcagtggtggttgtggtggtggtggcagtgctggttgttctctcggtggcctcttcgtagggctcctcggcctcctcctccacctcgtccccatcctccacatcctcatcatcatcagcttcctcttcctcaacatcagccacttcctcctcttcggcgacttctactactttgtcttcaccgccatcagcgtagtctgtgtccgctccaccccaccagacatcagagtcatcctcctctgcatccgcagaatccacgctgtcgctttcctcggccaacgggcagcatacaaactctacccctcggaacttgtcgatgccgcagggcagcagcatgccatagtcgtgcaagttagtgctcttctcgctgcatgtctctttggcgacggtgtgccagtgaagatgggtctcacaaacatccatccgctcctggtgtaggaacttgcacttgtcgggcacgagaagggcgtcgctcacaaactcaccaactaggcaacggtaaggaatcacgatgtgggtgtgtgtcttgcactgcttgcggccccgcttgcaccagttctggatggtcactggctggttggcttccaccacgtttgtgatctgcagttcagggtagacctcttggcagtactgcaagatgccctccttggtgccaatgcaggttttggtccctgacgggtctgactcccactttccattctgcacattcatgtgcatgttgagtttaccacagaacatggcgatctggggttctgccagcagcccggcgttgccatcagtgggtacctccagagcccgaaccgtccaggcggccagcaggagcagtgccaagctgggcagcatcgtgatcctgcgtgggccaccgagtgctccgtgtgcgagtggaagatccgccgcgccctggctgtgtccgcgccgccgccgccgtctccggtggccccgcgctcgctctgctcccggtgctctcgcctcccgccgccgaggaaactgac

SEQ ID NO: 28 - DNA, 2340 bp, Rattus rattus
ggtttagttctgcatctgctcaaagaacttgtatgttggattctcatatccattctgctgcatcttggagaggtggcgctcctccggggtcacagcagcgtcaacctccaccacgccatgatggatggatgtgtactgtttcttcttcagcatcaccaaggtgatgacaatcactgttgctatgacaacgccacccaccatgagtccaatgatggcacctttgtttgaacccacatcttctgcaaagaacaccagtttttgatggcggacttcgaagcctgaatcatgtccgaactccgcatccatcttcacttctgagatctcttctgtcttgatgtttgtcaacccagaccctggtcgagtggtcagtcctcggtcagcagcggggcgggcgtcgacaggctcaacttcattttctgtattggctggcacagagtccaccccaaaaggatgccacggttggagatcatccaggctgaattcgccattcacgggaaggagctccacagtggtcttcgtttcagtcaaagaaggcatgagagcatcgttgccgtaactgattctgggttcactgatcatgttggctaagacgtcgtcggagtagttctgctccttctgaagcagctcgtcaacttcatcttgaatctcctcagccacggcagggacgttgtagagcagggacagagactggttcatgcgctcgtagatcacacggaggtgtgtcataacctgggaccggatctgagcagctttcttggggtccaccatgcgcacatgttcaaaatgctttagggtgtgctgtctgtccttctgctctgcacggacgtacttcttcagcatgttgaacacatgatgaggccttggaggcaccgcctgcagtgcggtgatgtaattctcgagggccaggcgacggcgatcattgagcatggcttcaactctggccatgtgtgtctctacaagctgctgcctctcgttggctgcttcctgttccagagattccactttctcctggaaatgctggataacggccttcttgtcagctttgggcaaattcttggcttgacgttctgcctcctcccattctctcatgacctgggacattctctctcggtgcttggcttccaacctctctttggctttctggaaatgggcgtgctcgttctcatctccgggggtctccaggtacttgtcgactgcgtcaggggtgctggctgccgtcgtgggaagtttaaccggatcttggggaagaggttcactggtagtcttgagtaaactttgggatgacacgctgccacacaccgccatgcagtactcttcagtgtcaaagttgttcctgttgccgccacatccgccgtaaaagaatggggcgcactttccttcagtgacatcaaagtaccagcgggagatcattgcacggcatggcccggtctcagcttgttcagagcacacctctcggactacctcctccacagactcagtggtagttgtggtagtggtggcaatgctggttgttctctctgtggcctcttcgtagggctcctcggcctcctcctccacctcatccccatcctccacatcctcgtcatcctcagcttcttcttcctcaacatcggccacttcctcctcttcggctacttctacgactttgtcttcaccgccatcagcatagtctgtgtccgctccaccccaccagacatcggagtcgtcctcctctgcgtccgcagaatcgatgctgtcgctctcctccgccaacgggcagcacacgaactcgacccctcggaacttgtcgatgccacagggcagcagcatgccatagtcgtgcaagttagtgctcttctcactgcatgtctctttggcaacagtatgccagtgaagatgggtctcacaaacgtccatccgctcctggtgtagaaacttgcacttgtcgggcacgagaagggcatcgcttacaaactcaccaactaggcaccggtaaggaatcacgatgtgggtgtgcgtcttgcactgcttgcggccccgcttgcaccagttctggatggtcactggctggttggcttccaccacgtttgtgatctgcagttcagggtagacctcttggcagtactgcaggattccctccttggtgccaatgcaggttttggtccctgatgggtctgactcccattttccattctgcacattcatgtgcatgttgagtttaccacagaacatggcgatctggggttctgccagcagaccggcattgccatcagtgggcacctccagagcccgaaccgtccaggcggccagcaggagcagtgccaggctgggcagcatcgtgatcctgcgtgggccaccgac

SEQ ID NO: 29 - protein, 16 aa, Artificial
  Synthethic
AAVALLPAVLLALLAP

SEQ ID NO: 30 - protein, 11 aa, Artificial
  Synthethic
AALLPVLLAAP

SEQ ID NO: 31 - protein, 13 aa, Human immunodeficiency virus
GRKKRRQRRRPPQ

SEQ ID NO: 32 - protein, 16 aa, Drosophila melanogaster
RQIKIWFQNRRMKWKK

SEQ ID NO: 33 - DNA, 21 bp, Artificial
  Synthethic
gacccaauuaaguccuacuuu

SEQ ID NO: 34 - DNA, 23 bp, Artificial
  Synthethic
aaaguaggacuuaauugggucac

SEQ ID NO: 35 - RNA, 23 nt, Artificial
  Synthethic
gugacccaauuaaguccuacuuu

SEQ ID NO: 36 - DNA, 21 bp, Artificial
  Synthethic
ucuccugauuauuuaucacau

SEQ ID NO: 37 - DNA, 23 bp, Artificial
  Synthethic
augugataaauaaucaggagaga

SEQ ID NO: 38 - RNA, 23 nt, Artificial
  Synthethic
ucucuccugauuauuuaucacau

SEQ ID NO: 39 - DNA, 21 bp, Artificial
  Synthethic
ccugaacuugaauuaauccau

SEQ ID NO: 40 - DNA, 23 bp, Artificial
  Synthethic
auggautaauucaaguucaggca

SEQ ID NO: 41 - RNA, 23 nt, Artificial
  Synthethic
ugccugaacuugaauuaauccac

SEQ ID NO: 42 - DNA, 21 bp, Artificial
  Synthethic
gguucaaacaaaggugcaauu

SEQ ID NO: 43 - DNA, 23 bp, Artificial
  Synthethic
aauugcaccuuuguuugaaccca

SEQ ID NO: 44 - RNA, 23 nt, Artificial
  Synthethic
uggguucaaacaaaggugcaauc

SEQ ID NO: 45 - DNA, 21 bp, Artificial
  Synthethic
uuuacucauuaucgccuuuug

SEQ ID NO: 46 - DNA, 23 bp, Artificial
  Synthethic
caaaaggcgauaaugaguaaauc

SEQ ID NO: 47 - RNA, 23 nt, Artificial
  Synthethic
gauuuacucauuaucgccuuuug

SEQ ID NO: 48 - DNA, 21 bp, Artificial
  Synthethic
auuuagcuguaucaaacuagu

SEQ ID NO: 49 - DNA, 23 bp, Artificial
  Synthethic
acuagutugauacagcuaaauuc

SEQ ID NO: 50 - RNA, 23 nt, Artificial
  Synthethic
gaauuuagcuguaucaaacuagu

SEQ ID NO: 51 - DNA, 21 bp, Artificial
  Synthethic
aguauuccuuuccugaucacu

SEQ ID NO: 52 - DNA, 23 bp, Artificial
  Synthethic
agugaucaggaaaggaauacuua

SEQ ID NO: 53 - RNA, 23 nt, Artificial
  Synthethic
uaaguauuccuuuccugaucacu

SEQ ID NO: 54 - DNA, 21 bp, Artificial
  Synthethic
gcuuaugacaugaucgcuuuc

SEQ ID NO: 55 - DNA, 23 bp, Artificial
  Synthethic
gaaagcgaucaugucauaagcaa

SEQ ID NO: 56 - RNA, 23 nt, Artificial
  Synthethic
uugcuuaugacaugaucgcuuuc

SEQ ID NO: 57 - DNA, 21 bp, Artificial
  Synthethic
aagaugugucuucaauuugua

SEQ ID NO: 58 - DNA, 23 bp, Artificial
  Synthethic
uacaaatugaagacacaucuuaa

SEQ ID NO: 59 - RNA, 23 nt, Artificial
  Synthethic
uuaagaugugucuucaauuugua

SEQ ID NO: 60 - DNA, 21 bp, Artificial
  Synthethic
gcaaaaccauugcuucacuau

SEQ ID NO: 61 - DNA, 23 bp, Artificial
  Synthethic
auagugaagcaaugguuuugcug

SEQ ID NO: 62 - RNA, 23 nt, Artificial
  Synthethic
cagcaaaaccauugcuucacuac

SEQ ID NO: 63 - DNA, 21 bp, Homo sapiens
auuuacucauuaucgccuuuu

SEQ ID NO: 64 - DNA, 23 bp, Homo sapiens
aaaaggcgauaaugaguaaauca

SEQ ID NO: 65 - RNA, 23 nt, Homo sapiens
ugauuuacucauuaucgccuuuu

SEQ ID NO: 66 - DNA, 21 bp, Homo sapiens
uacucauuaucgccuuuugau

SEQ ID NO: 67 - DNA, 23 bp, Homo sapiens
aucaaaaggcgauaaugaguaaa

SEQ ID NO: 68 - RNA, 23 nt, Homo sapiens
uuuacucauuaucgccuuuugac

SEQ ID NO: 69 - DNA, 21 bp, Homo sapiens
ugccugaacuugaauuaaucu

SEQ ID NO: 70 - DNA, 23 bp, Artificial
  Synthethic
agauuaauucaaguucaggcauc

SEQ ID NO: 71 - RNA, 23 nt, Artificial
  Synthethic
gaugccugaacuugaauuaaucc

SEQ ID NO: 72 - DNA, 21 bp, Artificial
  Synthethic
cugaacuugaauuaauccaca

SEQ ID NO: 73 - DNA, 23 bp, Artificial
  Synthethic
uguggatuaauucaaguucaggc

SEQ ID NO: 74 - RNA, 23 nt, Artificial
  Synthethic
gccugaacuugaauuaauccaca

SEQ ID NO: 75 - DNA, 21 bp, Artificial
  Synthethic
uuuagcuguaucaaacuaguu

SEQ ID NO: 76 - DNA, 23 bp, Artificial
  Synthethic
aacuagtuugauacagcuaaauu

SEQ ID NO: 77 - RNA, 23 nt, Artificial
  Synthethic
aauuuagcuguaucaaacuagug

SEQ ID NO: 78 - DNA, 21 bp, Artificial
  Synthethic
gaauagauucucuccugauua

SEQ ID NO: 79 - DNA, 23 bp, Artificial
  Synthethic
uaaucaggagagaaucuauucau

SEQ ID NO: 80 - RNA, 23 nt, Artificial
  Synthethic
augaauagauucucuccugauua

SEQ ID NO: 81 - DNA, 21 bp, Artificial
  Synthethic
uccugauuauuuaucacauau

SEQ ID NO: 82 - DNA, 23 bp, Artificial
  Synthethic
auaugugauaaauaaucaggaga

SEQ ID NO: 83 - RNA, 23 nt, Artificial
  Synthethic
ucuccugauuauuuaucacauag

SEQ ID NO: 84 - DNA, 21 bp, Artificial
  Synthethic
cccaauuaaguccuacuuuau

SEQ ID NO: 85 - DNA, 23 bp, Artificial
  Synthethic
auaaagtaggacuuaauuggguc

SEQ ID NO: 86 - RNA, 23 nt, Artificial
  Synthethic
gacccaauuaaguccuacuuuac

SEQ ID NO: 87 - DNA, 21 bp, Artificial
  Synthethic
cauaugcuuuaagaaucgauu

SEQ ID NO: 88 - DNA, 23 bp, Artificial
  Synthethic
aaucgatucuuaaagcauaugua

SEQ ID NO: 89 - RNA, 23 nt, Artificial
  Synthethic
uacauaugcuuuaagaaucgaug

SEQ ID NO: 90 - DNA, 21 bp, Artificial
  Synthethic
cuucucuugccuaaguauucu

SEQ ID NO: 91 - DNA, 23 bp, Artificial
  Synthethic
agaauacuuaggcaagagaagca

SEQ ID NO: 92 - RNA, 23 nt, Artificial
  Synthethic
ugcuucucuugccuaaguauucc

SEQ ID NO: 93 - DNA, 21 bp, Artificial
  Synthethic
cauugcuuaugacaugaucgu

SEQ ID NO: 94 - DNA, 23 bp, Artificial
  Synthethic
acgaucaugucauaagcaaugau

SEQ ID NO: 95 - RNA, 23 nt, Artificial
  Synthethic
aucauugcuuaugacaugaucgc

SEQ ID NO: 96 - DNA, 21 bp, Artificial
  Synthethic
cuuaugacaugaucgcuuucu

SEQ ID NO: 97 - DNA, 23 bp, Artificial
  Synthethic
agaaagcgaucaugucauaagca

SEQ ID NO: 98 - RNA, 23 nt, Artificial
  Synthethic
ugcuuaugacaugaucgcuuucu

SEQ ID NO: 99 - DNA, 21 bp, Artificial
  Synthethic
uaugacaugaucgcuuucuau

SEQ ID NO: 100 - DNA, 23 bp, Artificial
  Synthethic
auagaaagcgaucaugucauaag

SEQ ID NO: 101 - RNA, 23 nt, Artificial
  Synthethic
cuuaugacaugaucgcuuucuac

SEQ ID NO: 102 - DNA, 21 bp, Artificial
  Synthethic
ugacaugaucgcuuucuacau

SEQ ID NO: 103 - DNA, 23 bp, Artificial
  Synthethic
auguagaaagcgaucaugucaua

SEQ ID NO: 104 - RNA, 23 nt, Artificial
  Synthethic
uaugacaugaucgcuuucuacac

SEQ ID NO: 105 - DNA, 21 bp, Artificial
  Synthethic
gaucgcuuucuacacuguauu

SEQ ID NO: 106 - DNA, 23 bp, Artificial
  Synthethic
aauacaguguagaaagcgaucau

SEQ ID NO: 107 - RNA, 23 nt, Artificial
  Synthethic
augaucgcuuucuacacuguauu

SEQ ID NO: 108 - DNA, 21 bp, Artificial
  Synthethic
aaaacuauucagaugacgucu

SEQ ID NO: 109 - DNA, 23 bp, Artificial
  Synthethic
agacgucaucugaauaguuuugc

SEQ ID NO: 110 - RNA, 23 nt, Artificial
  Synthethic
gcaaaacuauucagaugacgucu

SEQ ID NO: 111 - DNA, 21 bp, Artificial
  Synthethic
aaacuauucagaugacgucuu

SEQ ID NO: 112 - DNA, 23 bp, Artificial
  Synthethic
aagacgtcaucugaauaguuuug

SEQ ID NO: 113 - RNA, 23 nt, Artificial
  Synthethic
caaaacuauucagaugacgucuu

SEQ ID NO: 114 - DNA, 21 bp, Artificial
  Synthethic
acgaaaauccaaccuacaagu

SEQ ID NO: 115 - DNA, 23 bp, Artificial
  Synthethic
acuuguagguuggauuuucguag

SEQ ID NO: 116 - RNA, 23 nt, Artificial
  Synthethic
cuacgaaaauccaaccuacaagu

SEQ ID NO: 117 - DNA, 21 bp, Artificial
  Synthethic
ugcuucucuugccuaaguauu

SEQ ID NO: 118 - DNA, 23 bp, Artificial
  Synthethic
aauacutaggcaagagaagcagc

SEQ ID NO: 119 - RNA, 23 nt, Artificial
  Synthethic
gcugcuucucuugccuaaguauu

SEQ ID NO: 120 - DNA, 21 bp, Artificial
  Synthethic
ugcuuaugacaugaucgcuuu

SEQ ID NO: 121 - DNA, 23 bp, Artificial
  Synthethic
aaagcgaucaugucauaagcaau

SEQ ID NO: 122 - RNA, 23 nt, Artificial
  Synthethic
auugcuuaugacaugaucgcuuu

SEQ ID NO: 123 - DNA, 21 bp, Artificial
  Synthethic
ugaucgcuuucuacacuguau

SEQ ID NO: 124 - DNA, 23 bp, Artificial
  Synthethic
auacagtguagaaagcgaucaug

SEQ ID NO: 125 - RNA, 23 nt, Artificial
  Synthethic
caugaucgcuuucuacacuguau

SEQ ID NO: 126 - DNA, 21 bp, Artificial
  Synthethic
aucgcuuucuacacuguauua

SEQ ID NO: 127 - DNA, 23 bp, Artificial
  Synthethic
uaauacaguguagaaagcgauca

SEQ ID NO: 128 - RNA, 23 nt, Artificial
  Synthethic
ugaucgcuuucuacacuguauua

SEQ ID NO: 129 - DNA, 21 bp, Artificial
  Synthethic
ucuuugaccgaaacgaaaacu

SEQ ID NO: 130 - DNA, 23 bp, Artificial
  Synthethic
aguuuucguuucggucaaagaug

SEQ ID NO: 131 - RNA, 23 nt, Artificial
  Synthethic
caucuuugaccgaaacgaaaacc

SEQ ID NO: 132 - DNA, 21 bp, Artificial
  Synthethic
guucuggguugacaaauauca

SEQ ID NO: 133 - DNA, 23 bp, Artificial
  Synthethic
ugauautugucaacccagaaccu

SEQ ID NO: 134 - RNA, 23 nt, Artificial
  Synthethic
agguucuggguugacaaauauca

SEQ ID NO: 135 - DNA, 21 bp, Artificial
  Synthethic
uggguugacaaauaucaagau

SEQ ID NO: 136 - DNA, 23 bp, Artificial
  Synthethic
aucuugauauuugucaacccaga

SEQ ID NO: 137 - RNA, 23 nt, Artificial
  Synthethic
ucuggguugacaaauaucaagac

SEQ ID NO: 138 - DNA, 21 bp, Artificial
  Synthethic
gauuuacucauuaucgccuuu

SEQ ID NO: 139 - DNA, 23 bp, Artificial
  Synthethic
aaaggcgauaaugaguaaaucau

SEQ ID NO: 140 - RNA, 23 nt, Artificial
  Synthethic
augauuuacucauuaucgccuuu

SEQ ID NO: 141 - DNA, 21 bp, Artificial
  Synthethic
uccuuuccugaucacuaugca

SEQ ID NO: 142 - DNA, 23 bp, Artificial
  Synthethic
ugcauagugaucaggaaaggaau

SEQ ID NO: 143 - RNA, 23 nt, Artificial
  Synthethic
auuccuuuccugaucacuaugca

SEQ ID NO: 144 - DNA, 21 bp, Artificial
  Synthethic
cuuuccugaucacuaugcauu

SEQ ID NO: 145 - DNA, 23 bp, Artificial
  Synthethic
aaugcatagugaucaggaaagga

SEQ ID NO: 146 - RNA, 23 nt, Artificial
  Synthethic
uccuuuccugaucacuaugcauu

SEQ ID NO: 147 - DNA, 21 bp, Artificial
  Synthethic
auugcuuaugacaugaucgcu

SEQ ID NO: 148 - DNA, 23 bp, Artificial
  Synthethic
agcgaucaugucauaagcaauga

SEQ ID NO: 149 - RNA, 23 nt, Artificial
  Synthethic
ucauugcuuaugacaugaucgcu

SEQ ID NO: 150 - DNA, 21 bp, Artificial
  Synthethic
ucuuuaaccagucugaaguuu

SEQ ID NO: 151 - DNA, 23 bp, Artificial
  Synthethic
aaacuucagacugguuaaagaaa

SEQ ID NO: 152 - RNA, 23 nt, Artificial
  Synthethic
uuucuuuaaccagucugaaguuu

SEQ ID NO: 153 - DNA, 21 bp, Artificial
  Synthethic
ggaucaguuacggaaacgauu

SEQ ID NO: 154 - DNA, 23 bp, Artificial
  Synthethic
aaucgutuccguaacugauccuu

SEQ ID NO: 155 - RNA, 23 nt, Artificial
  Synthethic
aaggaucaguuacggaaacgaug

SEQ ID NO: 156 - DNA, 21 bp, Artificial
  Synthethic
cuggguugacaaauaucaaga

SEQ ID NO: 157 - DNA, 23 bp, Artificial
  Synthethic
ucuugatauuugucaacccagaa

SEQ ID NO: 158 - RNA, 23 nt, Artificial
  Synthethic
uucuggguugacaaauaucaaga

SEQ ID NO: 159 - DNA, 21 bp, Artificial
  Synthethic
augauuuacucauuaucgccu

SEQ ID NO: 160 - DNA, 23 bp, Artificial
  Synthethic
aggcgataaugaguaaaucauaa

SEQ ID NO: 161 - RNA, 23 nt, Artificial
  Synthethic
uuaugauuuacucauuaucgccu

SEQ ID NO: 162 - DNA, 21 bp, Artificial
  Synthethic
cuugugguuugugacccaauu

SEQ ID NO: 163 - DNA, 23 bp, Artificial
  Synthethic
aauugggucacaaaccacaagaa

SEQ ID NO: 164 - RNA, 23 nt, Artificial
  Synthethic
uucuugugguuugugacccaauu

SEQ ID NO: 165 - DNA, 21 bp, Artificial
  Synthethic
auaugcuuuaagaaucgaugu

SEQ ID NO: 166 - DNA, 23 bp, Artificial
  Synthethic
acaucgauucuuaaagcauaugu

SEQ ID NO: 167 - RNA, 23 nt, Artificial
  Synthethic
acauaugcuuuaagaaucgaugg

SEQ ID NO: 168 - DNA, 21 bp, Artificial
  Synthethic
uuuguccacguaucuuugggu

SEQ ID NO: 169 - DNA, 23 bp, Artificial
  Synthethic
acccaaagauacguggacaaaaa

SEQ ID NO: 170 - RNA, 23 nt, Artificial
  Synthethic
uuuuuguccacguaucuuugggu

SEQ ID NO: 171 - DNA, 21 bp, Artificial
  Synthethic
ucauuguaagcacuuuuacgu

SEQ ID NO: 172 - DNA, 23 bp, Artificial
  Synthethic
acguaaaagugcuuacaaugaac

SEQ ID NO: 173 - RNA, 23 nt, Artificial
  Synthethic
guucauuguaagcacuuuuacgg

SEQ ID NO: 174 - DNA, 21 bp, Artificial
  Synthethic
ggccaacaugauuagugaacu

SEQ ID NO: 175 - DNA, 23 bp, Artificial
  Synthethic
aguucacuaaucauguuggccaa

SEQ ID NO: 176 - RNA, 23 nt, Artificial
  Synthethic
uuggccaacaugauuagugaacc

SEQ ID NO: 177 - DNA, 21 bp, Artificial
  Synthethic
gaucaguuacggaaacgaugu

SEQ ID NO: 178 - DNA, 23 bp, Artificial
  Synthethic
acaucgtuuccguaacugauccu

SEQ ID NO: 179 - RNA, 23 nt, Artificial
  Synthethic
aggaucaguuacggaaacgaugc

SEQ ID NO: 180 - DNA, 21 bp, Artificial
  Synthethic
uacggaaacgaugcucucauu

SEQ ID NO: 181 - DNA, 23 bp, Artificial
  Synthethic
aaugagagcaucguuuccguaac

SEQ ID NO: 182 - RNA, 23 nt, Artificial
  Synthethic
guuacggaaacgaugcucucaug

SEQ ID NO: 183 - DNA, 21 bp, Artificial
  Synthethic
ugauuuacucauuaucgccuu

SEQ ID NO: 184 - DNA, 23 bp, Artificial
  Synthethic
aaggcgauaaugaguaaaucaua

SEQ ID NO: 185 - RNA, 23 nt, Artificial
  Synthethic
uaugauuuacucauuaucgccuu

SEQ ID NO: 186 - DNA, 21 bp, Artificial
  Synthethic
guagaugccugaacuugaauu

SEQ ID NO: 187 - DNA, 23 bp, Artificial
  Synthethic
aauucaaguucaggcaucuacuu

SEQ ID NO: 188 - RNA, 23 nt, Artificial
  Synthethic
aaguagaugccugaacuugaauu

SEQ ID NO: 189 - DNA, 21 bp, Artificial
  Synthethic
uuguauauuauucuugugguu

SEQ ID NO: 190 - DNA, 23 bp, Artificial
  Synthethic
aaccacaagaauaauauacaacu

SEQ ID NO: 191 - RNA, 23 nt, Artificial
  Synthethic
aguuguauauuauucuugugguu

SEQ ID NO: 192 - DNA, 21 bp, Artificial
  Synthethic
auugcugcuucugcuauauuu

SEQ ID NO: 193 - DNA, 23 bp, Artificial
  Synthethic
aaauauagcagaagcagcaaucu

SEQ ID NO: 194 - RNA, 23 nt, Artificial
  Synthethic
agauugcugcuucugcuauauuu

SEQ ID NO: 195 - DNA, 21 bp, Artificial
  Synthethic
ugcuauauuugugauauagga

SEQ ID NO: 196 - DNA, 23 bp, Artificial
  Synthethic
uccuauaucacaaauauagcaga

SEQ ID NO: 197 - RNA, 23 nt, Artificial
  Synthethic
ucugcuauauuugugauauagga

SEQ ID NO: 198 - DNA, 21 bp, Artificial
  Synthethic
acacauuaggcauugagacuu

SEQ ID NO: 199 - DNA, 23 bp, Artificial
  Synthethic
aagucucaaugccuaaugugugc

SEQ ID NO: 200 - RNA, 23 nt, Artificial
  Synthethic
gcacacauuaggcauugagacuu

SEQ ID NO: 201 - DNA, 21 bp, Artificial
  Synthethic
aagaaucccuguucauuguaa

SEQ ID NO: 202 - DNA, 23 bp, Artificial
  Synthethic
uuacaatgaacagggauucuuuu

SEQ ID NO: 203 - RNA, 23 nt, Artificial
  Synthethic
aaaagaaucccuguucauuguaa

SEQ ID NO: 204 - DNA, 21 bp, Artificial
  Synthethic
cauuguaagcacuuuuacggu

SEQ ID NO: 205 - DNA, 23 bp, Artificial
  Synthethic
accguaaaagugcuuacaaugaa

SEQ ID NO: 206 - RNA, 23 nt, Artificial
  Synthethic
uucauuguaagcacuuuuacggg

SEQ ID NO: 207 - DNA, 21 bp, Artificial
  Synthethic
uugcuuaugacaugaucgcuu

SEQ ID NO: 208 - DNA, 23 bp, Artificial
  Synthethic
aagcgatcaugucauaagcaaug

SEQ ID NO: 209 - RNA, 23 nt, Artificial
  Synthethic
cauugcuuaugacaugaucgcuu

SEQ ID NO: 210 - DNA, 21 bp, Artificial
  Synthethic
caaggaucaguuacggaaacu

SEQ ID NO: 211 - DNA, 23 bp, Artificial
  Synthethic
aguuuccguaacugauccuuggu

SEQ ID NO: 212 - RNA, 23 nt, Artificial
  Synthethic
accaaggaucaguuacggaaacg

SEQ ID NO: 213 - DNA, 21 bp, Artificial
  Synthethic
agguucuggguugacaaauau

SEQ ID NO: 214 - DNA, 23 bp, Artificial
  Synthethic
auauuugucaacccagaaccugg

SEQ ID NO: 215 - RNA, 23 nt, Artificial
  Synthethic
ccagguucuggguugacaaauau

SEQ ID NO: 216 - DNA, 21 bp, Artificial
  Synthethic
aagauguggguucaaacaaau

SEQ ID NO: 217 - DNA, 23 bp, Artificial
  Synthethic
auuugutugaacccacaucuucu

SEQ ID NO: 218 - RNA, 23 nt, Artificial
  Synthethic
agaagauguggguucaaacaaag

SEQ ID NO: 219 - DNA, 21 bp, Artificial
  Synthethic
cugaagaagaaacaguacaca

SEQ ID NO: 220 - DNA, 23 bp, Artificial
  Synthethic
uguguacuguuucuucuucagca

SEQ ID NO: 221 - RNA, 23 nt, Artificial
  Synthethic
ugcugaagaagaaacaguacaca

SEQ ID NO: 222 - DNA, 21 bp, Artificial
  Synthethic
aaguuggacagcaaaaccauu

SEQ ID NO: 223 - DNA, 23 bp, Artificial
  Synthethic
aauggutuugcuguccaacuuca

SEQ ID NO: 224 - RNA, 23 nt, Artificial
  Synthethic
ugaaguuggacagcaaaaccauu

SEQ ID NO: 225 - DNA, 21 bp, Artificial
  Synthethic
aucgguguccauuuauagaau

SEQ ID NO: 226 - DNA, 23 bp, Artificial
  Synthethic
auucuataaauggacaccgaugg

SEQ ID NO: 227 - RNA, 23 nt, Artificial
  Synthethic
ccaucgguguccauuuauagaau

SEQ ID NO: 228 - DNA, 21 bp, Artificial
  Synthethic
ucgguguccauuuauagaaua

SEQ ID NO: 229 - DNA, 23 bp, Artificial
  Synthethic
uauucuauaaauggacaccgaug

SEQ ID NO: 230 - RNA, 23 nt, Artificial
  Synthethic
caucgguguccauuuauagaaua

SEQ ID NO: 231 - DNA, 21 bp, Artificial
  Synthethic
gcuguaacacaaguagaugcu

SEQ ID NO: 232 - DNA, 23 bp, Artificial
  Synthethic
agcauctacuuguguuacagcac

SEQ ID NO: 233 - RNA, 23 nt, Artificial
  Synthethic
gugcuguaacacaaguagaugcc

SEQ ID NO: 234 - DNA, 21 bp, Artificial
  Synthethic
aaguagaugccugaacuugaa

SEQ ID NO: 235 - DNA, 23 bp, Artificial
  Synthethic
uucaagtucaggcaucuacuugu

SEQ ID NO: 236 - RNA, 23 nt, Artificial
  Synthethic
acaaguagaugccugaacuugaa

SEQ ID NO: 237 - DNA, 21 bp, Artificial
  Synthethic
uugugguuugugacccaauua

SEQ ID NO: 238 - DNA, 23 bp, Artificial
  Synthethic
uaauugggucacaaaccacaaga

SEQ ID NO: 239 - RNA, 23 nt, Artificial
  Synthethic
ucuugugguuugugacccaauua

SEQ ID NO: 240 - DNA, 21 bp, Artificial
  Synthethic
guuugugacccaauuaagucu

SEQ ID NO: 241 - DNA, 23 bp, Artificial
  Synthethic
agacuuaauugggucacaaacca

SEQ ID NO: 242 - RNA, 23 nt, Artificial
  Synthethic
ugguuugugacccaauuaagucc

SEQ ID NO: 243 - DNA, 21 bp, Artificial
  Synthethic
gugacccaauuaaguccuacu

SEQ ID NO: 244 - DNA, 23 bp, Artificial
  Synthethic
aguaggacuuaauugggucacaa

SEQ ID NO: 245 - RNA, 23 nt, Artificial
  Synthethic
uugugacccaauuaaguccuacu

SEQ ID NO: 246 - DNA, 21 bp, Artificial
  Synthethic
uaugcuuuaagaaucgauggu

SEQ ID NO: 247 - DNA, 23 bp, Artificial
  Synthethic
accaucgauucuuaaagcauaug

SEQ ID NO: 248 - RNA, 23 nt, Artificial
  Synthethic
cauaugcuuuaagaaucgauggg

SEQ ID NO: 249 - DNA, 21 bp, Artificial
  Synthethic
uuugugauauaggaauuaaga

SEQ ID NO: 250 - DNA, 23 bp, Artificial
  Synthethic
ucuuaatuccuauaucacaaaua

SEQ ID NO: 251 - RNA, 23 nt, Artificial
  Synthethic
uauuugugauauaggaauuaaga

SEQ ID NO: 252 - DNA, 21 bp, Artificial
  Synthethic
aaagaaucccuguucauugua

SEQ ID NO: 253 - DNA, 23 bp, Artificial
  Synthethic
uacaaugaacagggauucuuuuc

SEQ ID NO: 254 - RNA, 23 nt, Artificial
  Synthethic
gaaaagaaucccuguucauugua

SEQ ID NO: 255 - DNA, 21 bp, Artificial
  Synthethic
ugauuguacagaaucauugcu

SEQ ID NO: 256 - DNA, 23 bp, Artificial
  Synthethic
agcaaugauucuguacaaucauc

SEQ ID NO: 257 - RNA, 23 nt, Artificial
  Synthethic
gaugauuguacagaaucauugcu

SEQ ID NO: 258 - DNA, 21 bp, Artificial
  Synthethic
ugccuggacaaacccuucuuu

SEQ ID NO: 259 - DNA, 23 bp, Artificial
  Synthethic
aaagaaggguuuguccaggcaug

SEQ ID NO: 260 - RNA, 23 nt, Artificial
  Synthethic
caugccuggacaaacccuucuuu

SEQ ID NO: 261 - DNA, 21 bp, Artificial
  Synthethic
gagcaaaacuauucagaugau

SEQ ID NO: 262 - DNA, 23 bp, Artificial
  Synthethic
aucauctgaauaguuuugcucuu

SEQ ID NO: 263 - RNA, 23 nt, Artificial
  Synthethic
aagagcaaaacuauucagaugac

SEQ ID NO: 264 - DNA, 21 bp, Artificial
  Synthethic
agugaaccaaggaucaguuau

SEQ ID NO: 265 - DNA, 23 bp, Artificial
  Synthethic
auaacugauccuugguucacuaa

SEQ ID NO: 266 - RNA, 23 nt, Artificial
  Synthethic
uuagugaaccaaggaucaguuac

SEQ ID NO: 267 - DNA, 21 bp, Artificial
  Synthethic
ugaaccaaggaucaguuacgu

SEQ ID NO: 268 - DNA, 23 bp, Artificial
  Synthethic
acguaacugauccuugguucacu

SEQ ID NO: 269 - RNA, 23 nt, Artificial
  Synthethic
agugaaccaaggaucaguuacgg

SEQ ID NO: 270 - DNA, 21 bp, Artificial
  Synthethic
caguuacggaaacgaugcucu

SEQ ID NO: 271 - DNA, 23 bp, Artificial
  Synthethic
agagcatcguuuccguaacugau

SEQ ID NO: 272 - RNA, 23 nt, Artificial
  Synthethic
aucaguuacggaaacgaugcucu

SEQ ID NO: 273 - DNA, 21 bp, Artificial
  Synthethic
agaagauguggguucaaacaa

SEQ ID NO: 274 - DNA, 23 bp, Artificial
  Synthethic
uuguuugaacccacaucuucugc

SEQ ID NO: 275 - RNA, 23 nt, Artificial
  Synthethic
gcagaagauguggguucaaacaa

SEQ ID NO: 276 - DNA, 21 bp, Artificial
  Synthethic
ccucugaaguuggacagcaaa

SEQ ID NO: 277 - DNA, 23 bp, Artificial
  Synthethic
uuugcuguccaacuucagaggcu

SEQ ID NO: 278 - RNA, 23 nt, Artificial
  Synthethic
agccucugaaguuggacagcaaa

SEQ ID NO: 279 - DNA, 21 bp, Artificial
  Synthethic
uuaugauuuacucauuaucgu

SEQ ID NO: 280 - DNA, 23 bp, Artificial
  Synthethic
acgauaaugaguaaaucauaaaa

SEQ ID NO: 281 - RNA, 23 nt, Artificial
  Synthethic
uuuuaugauuuacucauuaucgc

SEQ ID NO: 282 - DNA, 21 bp, Artificial
  Synthethic
acagcugugcuguaacacaau

SEQ ID NO: 283 - DNA, 23 bp, Artificial
  Synthethic
auugugtuacagcacagcuguca

SEQ ID NO: 284 - RNA, 23 nt, Artificial
  Synthethic
ugacagcugugcuguaacacaag

SEQ ID NO: 285 - DNA, 21 bp, Artificial
  Synthethic
ugugacccaauuaaguccuau

SEQ ID NO: 286 - DNA, 23 bp, Artificial
  Synthethic
auaggacuuaauugggucacaaa

SEQ ID NO: 287 - RNA, 23 nt, Artificial
  Synthethic
uuugugacccaauuaaguccuac

SEQ ID NO: 288 - DNA, 21 bp, Artificial
  Synthethic
uacauaugcuuuaagaaucga

SEQ ID NO: 289 - DNA, 23 bp, Artificial
  Synthethic
ucgauucuuaaagcauauguaaa

SEQ ID NO: 290 - RNA, 23 nt, Artificial
  Synthethic
uuuacauaugcuuuaagaaucga

SEQ ID NO: 291 - DNA, 21 bp, Artificial
  Synthethic
guaaauaaauacauucuugga

SEQ ID NO: 292 - DNA, 23 bp, Artificial
  Synthethic
uccaagaauguauuuauuuacau

SEQ ID NO: 293 - RNA, 23 nt, Artificial
  Synthethic
auguaaauaaauacauucuugga

SEQ ID NO: 294 - DNA, 21 bp, Artificial
  Synthethic
ucaguuacggaaacgaugcuu

SEQ ID NO: 295 - DNA, 23 bp, Artificial
  Synthethic
aagcaucguuuccguaacugauc

SEQ ID NO: 296 - RNA, 23 nt, Artificial
  Synthethic
gaucaguuacggaaacgaugcuc

SEQ ID NO: 297 - DNA, 21 bp, Artificial
  Synthethic
cuucccgugaauggagaguuu

SEQ ID NO: 298 - DNA, 23 bp, Artificial
  Synthethic
aaacuctccauucacgggaagga

SEQ ID NO: 299 - RNA, 23 nt, Artificial
  Synthethic
uccuucccgugaauggagaguuc

SEQ ID NO: 300 - DNA, 21 bp, Artificial
  Synthethic
aguuggacagcaaaaccauuu

SEQ ID NO: 301 - DNA, 23 bp, Artificial
  Synthethic
aaauggtuuugcuguccaacuuc

SEQ ID NO: 302 - RNA, 23 nt, Artificial
  Synthethic
gaaguuggacagcaaaaccauug

SEQ ID NO: 303 - DNA, 21 bp, Artificial
  Synthethic
cccaucgguguccauuuauau

SEQ ID NO: 304 - DNA, 23 bp, Artificial
  Synthethic
auauaaauggacaccgaugggua

SEQ ID NO: 305 - RNA, 23 nt, Artificial
  Synthethic
uacccaucgguguccauuuauag

SEQ ID NO: 306 - DNA, 21 bp, Artificial
  Synthethic
ugcacacauuaggcauugaga

SEQ ID NO: 307 - DNA, 23 bp, Artificial
  Synthethic
ucucaatgccuaaugugugcaca

SEQ ID NO: 308 - RNA, 23 nt, Artificial
  Synthethic
ugugcacacauuaggcauugaga

SEQ ID NO: 309 - DNA, 21 bp, Artificial
  Synthethic
ccaacaugauuagugaaccaa

SEQ ID NO: 310 - DNA, 23 bp, Artificial
  Synthethic
uugguucacuaaucauguuggcc

SEQ ID NO: 311 - RNA, 23 nt, Artificial
  Synthethic
ggccaacaugauuagugaaccaa

SEQ ID NO: 312 - DNA, 21 bp, Artificial
  Synthethic
augauuagugaaccaaggauu

SEQ ID NO: 313 - DNA, 23 bp, Artificial
  Synthethic
aauccutgguucacuaaucaugu

SEQ ID NO: 314 - RNA, 23 nt, Artificial
  Synthethic
acaugauuagugaaccaaggauc

SEQ ID NO: 315 - DNA, 21 bp, Artificial
  Synthethic
uuagugaaccaaggaucaguu

SEQ ID NO: 316 - DNA, 23 bp, Artificial
  Synthethic
aacugatccuugguucacuaauc

SEQ ID NO: 317 - RNA, 23 nt, Artificial
  Synthethic
gauuagugaaccaaggaucaguu

SEQ ID NO: 318 - DNA, 21 bp, Artificial
  Synthethic
aaccaaggaucaguuacggaa

SEQ ID NO: 319 - DNA, 23 bp, Artificial
  Synthethic
uuccguaacugauccuugguuca

SEQ ID NO: 320 - RNA, 23 nt, Artificial
  Synthethic
ugaaccaaggaucaguuacggaa

SEQ ID NO: 321 - DNA, 21 bp, Artificial
  Synthethic
guuacggaaacgaugcucuca

SEQ ID NO: 322 - DNA, 23 bp, Artificial
  Synthethic
ugagagcaucguuuccguaacug

SEQ ID NO: 323 - RNA, 23 nt, Artificial
  Synthethic
caguuacggaaacgaugcucuca

SEQ ID NO: 324 - DNA, 21 bp, Artificial
  Synthethic
gaugcagaauuccgacaugau

SEQ ID NO: 325 - DNA, 23 bp, Artificial
  Synthethic
aucaugtcggaauucugcaucca

SEQ ID NO: 326 - RNA, 23 nt, Artificial
  Synthethic
uggaugcagaauuccgacaugac

SEQ ID NO: 327 - DNA, 21 bp, Artificial
  Synthethic
uuggacagcaaaaccauugcu

SEQ ID NO: 328 - DNA, 23 bp, Artificial
  Synthethic
agcaaugguuuugcuguccaacu

SEQ ID NO: 329 - RNA, 23 nt, Artificial
  Synthethic
aguuggacagcaaaaccauugcu

SEQ ID NO: 330 - DNA, 21 bp, Artificial
  Synthethic
aaaccauugcuucacuaccca

SEQ ID NO: 331 - DNA, 23 bp, Artificial
  Synthethic
uggguagugaagcaaugguuuug

SEQ ID NO: 332 - RNA, 23 nt, Artificial
  Synthethic
caaaaccauugcuucacuaccca

SEQ ID NO: 333 - DNA, 21 bp, Artificial
  Synthethic
ccaucgguguccauuuauaga

SEQ ID NO: 334 - DNA, 23 bp, Artificial
  Synthethic
ucuauaaauggacaccgaugggu

SEQ ID NO: 335 - RNA, 23 nt, Artificial
  Synthethic
acccaucgguguccauuuauaga

SEQ ID NO: 336 - DNA, 21 bp, Artificial
  Synthethic
uuaucgccuuuugacagcugu

SEQ ID NO: 337 - DNA, 23 bp, Artificial
  Synthethic
acagcugucaaaaggcgauaaug

SEQ ID NO: 338 - RNA, 23 nt, Artificial
  Synthethic
cauuaucgccuuuugacagcugu

SEQ ID NO: 339 - DNA, 21 bp, Artificial
  Synthethic
aucgccuuuugacagcugugu

SEQ ID NO: 340 - DNA, 23 bp, Artificial
  Synthethic
acacagcugucaaaaggcgauaa

SEQ ID NO: 341 - RNA, 23 nt, Artificial
  Synthethic
uuaucgccuuuugacagcugugc

SEQ ID NO: 342 - DNA, 21 bp, Artificial
  Synthethic
acacaaguagaugccugaacu

SEQ ID NO: 343 - DNA, 23 bp, Artificial
  Synthethic
aguucaggcaucuacuuguguua

SEQ ID NO: 344 - RNA, 23 nt, Artificial
  Synthethic
uaacacaaguagaugccugaacu

SEQ ID NO: 345 - DNA, 21 bp, Artificial
  Synthethic
ugugguuugugacccaauuaa

SEQ ID NO: 346 - DNA, 23 bp, Artificial
  Synthethic
uuaauugggucacaaaccacaag

SEQ ID NO: 347 - RNA, 23 nt, Artificial
  Synthethic
cuugugguuugugacccaauuaa

SEQ ID NO: 348 - DNA, 21 bp, Artificial
  Synthethic
gggaugcuucaugugaacguu

SEQ ID NO: 349 - DNA, 23 bp, Artificial
  Synthethic
aacguucacaugaagcauccccc

SEQ ID NO: 350 - RNA, 23 nt, Artificial
  Synthethic
gggggaugcuucaugugaacgug

SEQ ID NO: 351 - DNA, 21 bp, Artificial
  Synthethic
ugugcacacauuaggcauuga

SEQ ID NO: 352 - DNA, 23 bp, Artificial
  Synthethic
ucaaugccuaaugugugcacaua

SEQ ID NO: 353 - RNA, 23 nt, Artificial
  Synthethic
uaugugcacacauuaggcauuga

SEQ ID NO: 354 - DNA, 21 bp, Artificial
  Synthethic
aaauggaaguggcaauauaau

SEQ ID NO: 355 - DNA, 23 bp, Artificial
  Synthethic
auuauatugccacuuccauuuuc

SEQ ID NO: 356 - RNA, 23 nt, Artificial
  Synthethic
gaaaauggaaguggcaauauaag

SEQ ID NO: 357 - DNA, 21 bp, Artificial
  Synthethic
auggaaguggcaauauaaggu

SEQ ID NO: 358 - DNA, 23 bp, Artificial
  Synthethic
accuuatauugccacuuccauuu

SEQ ID NO: 359 - RNA, 23 nt, Artificial
  Synthethic
aaauggaaguggcaauauaaggg

SEQ ID NO: 360 - DNA, 21 bp, Artificial
  Synthethic
ugcccgagauccuguuaaacu

SEQ ID NO: 361 - DNA, 23 bp, Artificial
  Synthethic
aguuuaacaggaucucgggcaag

SEQ ID NO: 362 - RNA, 23 nt, Artificial
  Synthethic
cuugcccgagauccuguuaaacu

SEQ ID NO: 363 - DNA, 21 bp, Artificial
  Synthethic
auuagugaaccaaggaucagu

SEQ ID NO: 364 - DNA, 23 bp, Artificial
  Synthethic
acugauccuugguucacuaauca

SEQ ID NO: 365 - RNA, 23 nt, Artificial
  Synthethic
ugauuagugaaccaaggaucagu

SEQ ID NO: 366 - DNA, 21 bp, Artificial
  Synthethic
gaaccaaggaucaguuacgga

SEQ ID NO: 367 - DNA, 23 bp, Artificial
  Synthethic
uccguaacugauccuugguucac

SEQ ID NO: 368 - RNA, 23 nt, Artificial
  Synthethic
gugaaccaaggaucaguuacgga

SEQ ID NO: 369 - DNA, 21 bp, Artificial
  Synthethic
aaggaucaguuacggaaacga

SEQ ID NO: 370 - DNA, 23 bp, Artificial
  Synthethic
ucguuuccguaacugauccuugg

SEQ ID NO: 371 - RNA, 23 nt, Artificial
  Synthethic
ccaaggaucaguuacggaaacga

SEQ ID NO: 372 - DNA, 21 bp, Artificial
  Synthethic
caacacagaaaacgaaguuga

SEQ ID NO: 373 - DNA, 23 bp, Artificial
  Synthethic
ucaacutcguuuucuguguuggc

SEQ ID NO: 374 - RNA, 23 nt, Artificial
  Synthethic
gccaacacagaaaacgaaguuga

SEQ ID NO: 375 - DNA, 21 bp, Artificial
  Synthethic
uggguucaaacaaaggugcaa

SEQ ID NO: 376 - DNA, 23 bp, Artificial
  Synthethic
uugcaccuuuguuugaacccaca

SEQ ID NO: 377 - RNA, 23 nt, Artificial
  Synthethic
uguggguucaaacaaaggugcaa

SEQ ID NO: 378 - DNA, 21 bp, Artificial
  Synthethic
cagugaucgucaucaccuugu

SEQ ID NO: 379 - DNA, 23 bp, Artificial
  Synthethic
acaaggtgaugacgaucacuguc

SEQ ID NO: 380 - RNA, 23 nt, Artificial
  Synthethic
gacagugaucgucaucaccuugg

SEQ ID NO: 381 - DNA, 21 bp, Artificial
  Synthethic
acccaucgguguccauuuaua

SEQ ID NO: 382 - DNA, 23 bp, Artificial
  Synthethic
uauaaatggacaccgauggguag

SEQ ID NO: 383 - RNA, 23 nt, Artificial
  Synthethic
cuacccaucgguguccauuuaua

SEQ ID NO: 384 - DNA, 21 bp, Artificial
  Synthethic
ucuugugguuugugacccaau

SEQ ID NO: 385 - DNA, 23 bp, Artificial
  Synthethic
auugggtcacaaaccacaagaau

SEQ ID NO: 386 - RNA, 23 nt, Artificial
  Synthethic
auucuugugguuugugacccaau

SEQ ID NO: 387 - DNA, 21 bp, Artificial
  Synthethic
uuugugacccaauuaaguccu

SEQ ID NO: 388 - DNA, 23 bp, Artificial
  Synthethic
aggacutaauugggucacaaacc

SEQ ID NO: 389 - RNA, 23 nt, Artificial
  Synthethic
gguuugugacccaauuaaguccu

SEQ ID NO: 390 - DNA, 21 bp, Artificial
  Synthethic
uugugacccaauuaaguccua

SEQ ID NO: 391 - DNA, 23 bp, Artificial
  Synthethic
uaggactuaauugggucacaaac

SEQ ID NO: 392 - RNA, 23 nt, Artificial
  Synthethic
guuugugacccaauuaaguccua

SEQ ID NO: 393 - DNA, 21 bp, Artificial
  Synthethic
uucagaugacgucuuggccaa

SEQ ID NO: 394 - DNA, 23 bp, Artificial
  Synthethic
uuggccaagacgucaucugaaua

SEQ ID NO: 395 - RNA, 23 nt, Artificial
  Synthethic
uauucagaugacgucuuggccaa

SEQ ID NO: 396 - DNA, 21 bp, Artificial
  Synthethic
aucaguuacggaaacgaugcu

SEQ ID NO: 397 - DNA, 23 bp, Artificial
  Synthethic
agcaucguuuccguaacugaucc

SEQ ID NO: 398 - RNA, 23 nt, Artificial
  Synthethic
ggaucaguuacggaaacgaugcu

SEQ ID NO: 399 - DNA, 21 bp, Artificial
  Synthethic
uggaugcagaauuccgacauu

SEQ ID NO: 400 - DNA, 23 bp, Artificial
  Synthethic
aaugucggaauucugcauccauc

SEQ ID NO: 401 - RNA, 23 nt, Artificial
  Synthethic
gauggaugcagaauuccgacaug

SEQ ID NO: 402 - DNA, 21 bp, Artificial
  Synthethic
guccaagaugcagcagaacgu

SEQ ID NO: 403 - DNA, 23 bp, Artificial
  Synthethic
acguuctgcugcaucuuggacag

SEQ ID NO: 404 - RNA, 23 nt, Artificial
  Synthethic
cuguccaagaugcagcagaacgg

SEQ ID NO: 405 - DNA, 21 bp, Artificial
  Synthethic
uacccaucgguguccauuuau

SEQ ID NO: 406 - DNA, 23 bp, Artificial
  Synthethic
auaaauggacaccgauggguagu

SEQ ID NO: 407 - RNA, 23 nt, Artificial
  Synthethic
acuacccaucgguguccauuuau

SEQ ID NO: 408 - DNA, 21 bp, Artificial
  Synthethic
uuuugacagcugugcuguaau

SEQ ID NO: 409 - DNA, 23 bp, Artificial
  Synthethic
auuacagcacagcugucaaaagg

SEQ ID NO: 410 - RNA, 23 nt, Artificial
  Synthethic
ccuuuugacagcugugcuguaac

SEQ ID NO: 411 - DNA, 21 bp, Artificial
  Synthethic
uugacagcugugcuguaacau

SEQ ID NO: 412 - DNA, 23 bp, Artificial
  Synthethic
auguuacagcacagcugucaaaa

SEQ ID NO: 413 - RNA, 23 nt, Artificial
  Synthethic
uuuugacagcugugcuguaacac

SEQ ID NO: 414 - DNA, 21 bp, Artificial
  Synthethic
agcugugcuguaacacaagua

SEQ ID NO: 415 - DNA, 23 bp, Artificial
  Synthethic
uacuugtguuacagcacagcugu

SEQ ID NO: 416 - RNA, 23 nt, Artificial
  Synthethic
acagcugugcuguaacacaagua

SEQ ID NO: 417 - DNA, 21 bp, Artificial
  Synthethic
guuuuaugugcacacauuagu

SEQ ID NO: 418 - DNA, 23 bp, Artificial
  Synthethic
acuaaugugugcacauaaaacag

SEQ ID NO: 419 - RNA, 23 nt, Artificial
  Synthethic
cuguuuuaugugcacacauuagg

SEQ ID NO: 420 - DNA, 21 bp, Artificial
  Synthethic
uucaauuaccaagaauucucu

SEQ ID NO: 421 - DNA, 23 bp, Artificial
  Synthethic
agagaatucuugguaauugaaga

SEQ ID NO: 422 - RNA, 23 nt, Artificial
  Synthethic
ucuucaauuaccaagaauucucc

SEQ ID NO: 423 - DNA, 21 bp, Artificial
  Synthethic
cacacaucaguaauguauucu

SEQ ID NO: 424 - DNA, 23 bp, Artificial
  Synthethic
agaauacauuacugaugugugga

SEQ ID NO: 425 - RNA, 23 nt, Artificial
  Synthethic
uccacacaucaguaauguauucu

SEQ ID NO: 426 - DNA, 21 bp, Artificial
  Synthethic
uggucucuauacuacauuauu

SEQ ID NO: 427 - DNA, 23 bp, Artificial
  Synthethic
aauaauguaguauagagaccaaa

SEQ ID NO: 428 - RNA, 23 nt, Artificial
  Synthethic
uuuggucucuauacuacauuauu

SEQ ID NO: 429 - DNA, 21 bp, Artificial
  Synthethic
acccguuuuaugauuuacuca

SEQ ID NO: 430 - DNA, 23 bp, Artificial
  Synthethic
ugaguaaaucauaaaacggguuu

SEQ ID NO: 431 - RNA, 23 nt, Artificial
  Synthethic
aaacccguuuuaugauuuacuca

SEQ ID NO: 432 - DNA, 21 bp, Artificial
  Synthethic
uacgaaaauccaaccuacaau

SEQ ID NO: 433 - DNA, 23 bp, Artificial
  Synthethic
auuguagguuggauuuucguagc

SEQ ID NO: 434 - RNA, 23 nt, Artificial
  Synthethic
gcuacgaaaauccaaccuacaag

SEQ ID NO: 435 - DNA, 21 bp, Artificial
  Synthethic
uccacacaucaguaauguauu

SEQ ID NO: 436 - DNA, 23 bp, Artificial
  Synthethic
aauacatuacugauguguggauu

SEQ ID NO: 437 - RNA, 23 nt, Artificial
  Synthethic
aauccacacaucaguaauguauu

SEQ ID NO: 438 - DNA, 21 bp, Artificial
  Synthethic
cuggucuucaauuaccaagaa

SEQ ID NO: 439 - DNA, 23 bp, Artificial
  Synthethic
uucuugguaauugaagaccagca

SEQ ID NO: 440 - RNA, 23 nt, Artificial
  Synthethic
ugcuggucuucaauuaccaagaa

SEQ ID NO: 441 - DNA, 21 bp, Artificial
  Synthethic
gccaucuuugaccgaaacgaa

SEQ ID NO: 442 - DNA, 23 bp, Artificial
  Synthethic
uucguutcggucaaagauggcau

SEQ ID NO: 443 - RNA, 23 nt, Artificial
  Synthethic
augccaucuuugaccgaaacgaa

SEQ ID NO: 444 - DNA, 21 bp, Artificial
  Synthethic
ccaucuuugaccgaaacgaaa

SEQ ID NO: 445 - DNA, 23 bp, Artificial
  Synthethic
uuucgutucggucaaagauggca

SEQ ID NO: 446 - RNA, 23 nt, Artificial
  Synthethic
ugccaucuuugaccgaaacgaaa

SEQ ID NO: 447 - DNA, 21 bp, Artificial
  Synthethic
cuacgaaaauccaaccuacaa

SEQ ID NO: 448 - DNA, 23 bp, Artificial
  Synthethic
uuguagguuggauuuucguagcc

SEQ ID NO: 449 - RNA, 23 nt, Artificial
  Synthethic
ggcuacgaaaauccaaccuacaa

SEQ ID NO: 450 - DNA, 21 bp, Artificial
  Synthethic
auccacacaucaguaauguau

SEQ ID NO: 451 - DNA, 23 bp, Artificial
  Synthethic
auacautacugauguguggauua

SEQ ID NO: 452 - RNA, 23 nt, Artificial
  Synthethic
uaauccacacaucaguaauguau

SEQ ID NO: 453 - DNA, 21 bp, Artificial
  Synthethic
caugccaucuuugaccgaaau

SEQ ID NO: 454 - DNA, 23 bp, Artificial
  Synthethic
auuucggucaaagauggcaugag

SEQ ID NO: 455 - RNA, 23 nt, Artificial
  Synthethic
cucaugccaucuuugaccgaaac

SEQ ID NO: 456 - DNA, 21 bp, Artificial
  Synthethic
ggcuacgaaaauccaaccuau

SEQ ID NO: 457 - DNA, 23 bp, Artificial
  Synthethic
auaggutggauuuucguagccgu

SEQ ID NO: 458 - RNA, 23 nt, Artificial
  Synthethic
acggcuacgaaaauccaaccuac

SEQ ID NO: 459 - DNA, 21 bp, Artificial
  Synthethic
ucaugccaucuuugaccgaaa

SEQ ID NO: 460 - DNA, 23 bp, Artificial
  Synthethic
uuucggtcaaagauggcaugaga

SEQ ID NO: 461 - RNA, 23 nt, Artificial
  Synthethic
ucucaugccaucuuugaccgaaa

SEQ ID NO: 462 - DNA, 21 bp, Artificial
  Synthethic
caguacacauccauucaucau

SEQ ID NO: 463 - DNA, 23 bp, Artificial
  Synthethic
augaugaauggauguguacuguu

SEQ ID NO: 464 - RNA, 23 nt, Artificial
  Synthethic
aacaguacacauccauucaucau

SEQ ID NO: 465 - DNA, 21 bp, Artificial
  Synthethic
aacggcuacgaaaauccaacu

SEQ ID NO: 466 - DNA, 23 bp, Artificial
  Synthethic
aguuggauuuucguagccguucu

SEQ ID NO: 467 - RNA, 23 nt, Artificial
  Synthethic
agaacggcuacgaaaauccaacc

SEQ ID NO: 468 - DNA, 21 bp, Artificial
  Synthethic
gaaguuucauuuaugauacaa

SEQ ID NO: 469 - DNA, 23 bp, Artificial
  Synthethic
uuguaucauaaaugaaacuucag

SEQ ID NO: 470 - RNA, 23 nt, Artificial
  Synthethic
cugaaguuucauuuaugauacaa

SEQ ID NO: 471 - DNA, 21 bp, Artificial
  Synthethic
augccaucuuugaccgaaacu

SEQ ID NO: 472 - DNA, 23 bp, Artificial
  Synthethic
aguuucggucaaagauggcauga

SEQ ID NO: 473 - RNA, 23 nt, Artificial
  Synthethic
ucaugccaucuuugaccgaaacg

SEQ ID NO: 474 - DNA, 21 bp, Artificial
  Synthethic
gaacggcuacgaaaauccaau

SEQ ID NO: 475 - DNA, 23 bp, Artificial
  Synthethic
auuggatuuucguagccguucug

SEQ ID NO: 476 - RNA, 23 nt, Artificial
  Synthethic
cagaacggcuacgaaaauccaac

SEQ ID NO: 477 - DNA, 21 bp, Artificial
  Synthethic
ucuucgugccuguuuuauguu

SEQ ID NO: 478 - DNA, 23 bp, Artificial
  Synthethic
aacauaaaacaggcacgaagaaa

SEQ ID NO: 479 - RNA, 23 nt, Artificial
  Synthethic
uuucuucgugccuguuuuaugug

SEQ ID NO: 480 - DNA, 21 bp, Artificial
  Synthethic
uugcccgagauccuguuaaau

SEQ ID NO: 481 - DNA, 23 bp, Artificial
  Synthethic
auuuaacaggaucucgggcaaga

SEQ ID NO: 482 - RNA, 23 nt, Artificial
  Synthethic
ucuugcccgagauccuguuaaac

SEQ ID NO: 483 - DNA, 21 bp, Artificial
  Synthethic
cuucgugccuguuuuaugugu

SEQ ID NO: 484 - DNA, 23 bp, Artificial
  Synthethic
acacauaaaacaggcacgaagaa

SEQ ID NO: 485 - RNA, 23 nt, Artificial
  Synthethic
uucuucgugccuguuuuaugugc

SEQ ID NO: 486 - DNA, 21 bp, Artificial
  Synthethic
gcgccaugucccaaaguuuau

SEQ ID NO: 487 - DNA, 23 bp, Artificial
  Synthethic
auaaactuugggacauggcgcug

SEQ ID NO: 488 - RNA, 23 nt, Artificial
  Synthethic
cagcgccaugucccaaaguuuac

SEQ ID NO: 489 - DNA, 21 bp, Artificial
  Synthethic
gucauagcgacagugaucguu

SEQ ID NO: 490 - DNA, 23 bp, Artificial
  Synthethic
aacgaucacugucgcuaugacaa

SEQ ID NO: 491 - RNA, 23 nt, Artificial
  Synthethic
uugucauagcgacagugaucguc

SEQ ID NO: 492 - DNA, 21 bp, Artificial
  Synthethic
gcuacgaaaauccaaccuaca

SEQ ID NO: 493 - DNA, 23 bp, Artificial
  Synthethic
uguaggtuggauuuucguagccg

SEQ ID NO: 494 - RNA, 23 nt, Artificial
  Synthethic
cggcuacgaaaauccaaccuaca

SEQ ID NO: 495 - DNA, 21 bp, Artificial
  Synthethic
auagcgacagugaucgucauu

SEQ ID NO: 496 - DNA, 23 bp, Artificial
  Synthethic
aaugacgaucacugucgcuauga

SEQ ID NO: 497 - RNA, 23 nt, Artificial
  Synthethic
ucauagcgacagugaucgucauc

SEQ ID NO: 498 - DNA, 21 bp, Artificial
  Synthethic
cuugcccgagauccuguuaaa

SEQ ID NO: 499 - DNA, 23 bp, Artificial
  Synthethic
uuuaacaggaucucgggcaagag

SEQ ID NO: 500 - RNA, 23 nt, Artificial
  Synthethic
cucuugcccgagauccuguuaaa

SEQ ID NO: 501 - DNA, 21 bp, Artificial
  Synthethic
cucaugccaucuuugaccgaa

SEQ ID NO: 502 - DNA, 23 bp, Artificial
  Synthethic
uucggucaaagauggcaugagag

SEQ ID NO: 503 - RNA, 23 nt, Artificial
  Synthethic
cucucaugccaucuuugaccgaa

SEQ ID NO: 504 - DNA, 21 bp, Artificial
  Synthethic
acggcuacgaaaauccaaccu

SEQ ID NO: 505 - DNA, 23 bp, Artificial
  Synthethic
agguuggauuuucguagccguuc

SEQ ID NO: 506 - RNA, 23 nt, Artificial
  Synthethic
gaacggcuacgaaaauccaaccu

SEQ ID NO: 507 - DNA, 21 bp, Artificial
  Synthethic
caucaaaaauugguguucuuu

SEQ ID NO: 508 - DNA, 23 bp, Artificial
  Synthethic
aaagaacaccaauuuuugaugau

SEQ ID NO: 509 - RNA, 23 nt, Artificial
  Synthethic
aucaucaaaaauugguguucuuu

SEQ ID NO: 510 - DNA, 21 bp, Artificial
  Synthethic
auccaaccuacaaguucuuug

SEQ ID NO: 511 - DNA, 23 bp, Artificial
  Synthethic
caaagaacuuguagguuggauuu

SEQ ID NO: 512 - RNA, 23 nt, Artificial
  Synthethic
aaauccaaccuacaaguucuuug

SEQ ID NO: 513 - DNA, 21 bp, Artificial
  Synthethic
cgcuuucuacacuguauuaca

SEQ ID NO: 514 - DNA, 23 bp, Artificial
  Synthethic
uguaauacaguguagaaagcgau

SEQ ID NO: 515 - RNA, 23 nt, Artificial
  Synthethic
aucgcuuucuacacuguauuaca

SEQ ID NO: 516 - DNA, 21 bp, Artificial
  Synthethic
uccaaccuacaaguucuuuga

SEQ ID NO: 517 - DNA, 23 bp, Artificial
  Synthethic
ucaaagaacuuguagguuggauu

SEQ ID NO: 518 - RNA, 23 nt, Artificial
  Synthethic
aauccaaccuacaaguucuuuga

SEQ ID NO: 519 - DNA, 21 bp, Artificial
  Synthethic
ucucucuuuacauuuuggucu

SEQ ID NO: 520 - DNA, 23 bp, Artificial
  Synthethic
agaccaaaauguaaagagagaua

SEQ ID NO: 521 - RNA, 23 nt, Artificial
  Synthethic
uaucucucuuuacauuuuggucu

SEQ ID NO: 522 - DNA, 21 bp, Artificial
  Synthethic
cucucuuuacauuuuggucuu

SEQ ID NO: 523 - DNA, 23 bp, Artificial
  Synthethic
aagaccaaaauguaaagagagau

SEQ ID NO: 524 - RNA, 23 nt, Artificial
  Synthethic
aucucucuuuacauuuuggucuc

SEQ ID NO: 525 - DNA, 21 bp, Artificial
  Synthethic
uuuguguacuguaaagaauuu

SEQ ID NO: 526 - DNA, 23 bp, Artificial
  Synthethic
aaauuctuuacaguacacaaaac

SEQ ID NO: 527 - RNA, 23 nt, Artificial
  Synthethic
guuuuguguacuguaaagaauuu

SEQ ID NO: 528 - DNA, 21 bp, Artificial
  Synthethic
guguacuguaaagaauuuagu

SEQ ID NO: 529 - DNA, 23 bp, Artificial
  Synthethic
acuaaatucuuuacaguacacaa

SEQ ID NO: 530 - RNA, 23 nt, Artificial
  Synthethic
uuguguacuguaaagaauuuagc

SEQ ID NO: 531 - DNA, 21 bp, Artificial
  Synthethic
acccaauuaaguccuacuuua

SEQ ID NO: 532 - DNA, 23 bp, Artificial
  Synthethic
uaaaguaggacuuaauuggguca

SEQ ID NO: 533 - RNA, 23 nt, Artificial
  Synthethic
ugacccaauuaaguccuacuuua

SEQ ID NO: 534 - DNA, 21 bp, Artificial
  Synthethic
uccuacuuuacauaugcuuua

SEQ ID NO: 535 - DNA, 23 bp, Artificial
  Synthethic
uaaagcauauguaaaguaggacu

SEQ ID NO: 536 - RNA, 23 nt, Artificial
  Synthethic
aguccuacuuuacauaugcuuua

SEQ ID NO: 537 - DNA, 21 bp, Artificial
  Synthethic
ccuacuuuacauaugcuuuaa

SEQ ID NO: 538 - DNA, 23 bp, Artificial
  Synthethic
uuaaagcauauguaaaguaggac

SEQ ID NO: 539 - RNA, 23 nt, Artificial
  Synthethic
guccuacuuuacauaugcuuuaa

SEQ ID NO: 540 - DNA, 21 bp, Artificial
  Synthethic
uucuacacuguauuacauaaa

SEQ ID NO: 541 - DNA, 23 bp, Artificial
  Synthethic
uuuaugtaauacaguguagaaag

SEQ ID NO: 542 - RNA, 23 nt, Artificial
  Synthethic
cuuucuacacuguauuacauaaa

SEQ ID NO: 543 - DNA, 21 bp, Artificial
  Synthethic
ucuacacuguauuacauaaau

SEQ ID NO: 544 - DNA, 23 bp, Artificial
  Synthethic
auuuauguaauacaguguagaaa

SEQ ID NO: 545 - RNA, 23 nt, Artificial
  Synthethic
uuucuacacuguauuacauaaau

SEQ ID NO: 546 - DNA, 21 bp, Artificial
  Synthethic
cuuuuaagaugugucuucaau

SEQ ID NO: 547 - DNA, 23 bp, Artificial
  Synthethic
auugaagacacaucuuaaaagaa

SEQ ID NO: 548 - RNA, 23 nt, Artificial
  Synthethic
uucuuuuaagaugugucuucaau

SEQ ID NO: 549 - DNA, 21 bp, Artificial
  Synthethic
augugucuucaauuuguauaa

SEQ ID NO: 550 - DNA, 23 bp, Artificial
  Synthethic
uuauacaaauugaagacacaucu

SEQ ID NO: 551 - RNA, 23 nt, Artificial
  Synthethic
agaugugucuucaauuuguauaa

SEQ ID NO: 552 - DNA, 21 bp, Artificial
  Synthethic
aucaaaaauugguguucuuug

SEQ ID NO: 553 - DNA, 23 bp, Artificial
  Synthethic
caaagaacaccaauuuuugauga

SEQ ID NO: 554 - RNA, 23 nt, Artificial
  Synthethic
ucaucaaaaauugguguucuuug

SEQ ID NO: 555 - DNA, 21 bp, Artificial
  Synthethic
aaauccaaccuacaaguucuu

SEQ ID NO: 556 - DNA, 23 bp, Artificial
  Synthethic
aagaactuguagguuggauuuuc

SEQ ID NO: 557 - RNA, 23 nt, Artificial
  Synthethic
gaaaauccaaccuacaaguucuu

SEQ ID NO: 558 - DNA, 21 bp, Artificial
  Synthethic
guacuguaaagaauuuagcuu

SEQ ID NO: 559 - DNA, 23 bp, Artificial
  Synthethic
aagcuaaauucuuuacaguacac

SEQ ID NO: 560 - RNA, 23 nt, Artificial
  Synthethic
guguacuguaaagaauuuagcug

SEQ ID NO: 561 - DNA, 21 bp, Artificial
  Synthethic
cuccugauuauuuaucacaua

SEQ ID NO: 562 - DNA, 23 bp, Artificial
  Synthethic
uaugugauaaauaaucaggagag

SEQ ID NO: 563 - RNA, 23 nt, Artificial
  Synthethic
cucuccugauuauuuaucacaua

SEQ ID NO: 564 - DNA, 21 bp, Artificial
  Synthethic
gccaguuguauauuauucuuu

SEQ ID NO: 565 - DNA, 23 bp, Artificial
  Synthethic
aaagaataauauacaacuggcua

SEQ ID NO: 566 - RNA, 23 nt, Artificial
  Synthethic
uagccaguuguauauuauucuug

SEQ ID NO: 567 - DNA, 21 bp, Artificial
  Synthethic
aauuaaguccuacuuuacaua

SEQ ID NO: 568 - DNA, 23 bp, Artificial
  Synthethic
uauguaaaguaggacuuaauugg

SEQ ID NO: 569 - RNA, 23 nt, Artificial
  Synthethic
ccaauuaaguccuacuuuacaua

SEQ ID NO: 570 - DNA, 21 bp, Artificial
  Synthethic
cuugccuaaguauuccuuucu

SEQ ID NO: 571 - DNA, 23 bp, Artificial
  Synthethic
agaaaggaauacuuaggcaagag

SEQ ID NO: 572 - RNA, 23 nt, Artificial
  Synthethic
cucuugccuaaguauuccuuucc

SEQ ID NO: 573 - DNA, 21 bp, Artificial
  Synthethic
auuccuuuccugaucacuauu

SEQ ID NO: 574 - DNA, 23 bp, Artificial
  Synthethic
aauagugaucaggaaaggaauac

SEQ ID NO: 575 - RNA, 23 nt, Artificial
  Synthethic
guauuccuuuccugaucacuaug

SEQ ID NO: 576 - DNA, 21 bp, Artificial
  Synthethic
acuaugcauuuuaaaguuaaa

SEQ ID NO: 577 - DNA, 23 bp, Artificial
  Synthethic
uuuaactuuaaaaugcauaguga

SEQ ID NO: 578 - RNA, 23 nt, Artificial
  Synthethic
ucacuaugcauuuuaaaguuaaa

SEQ ID NO: 579 - DNA, 21 bp, Artificial
  Synthethic
uguucauuguaagcacuuuua

SEQ ID NO: 580 - DNA, 23 bp, Artificial
  Synthethic
uaaaagtgcuuacaaugaacagg

SEQ ID NO: 581 - RNA, 23 nt, Artificial
  Synthethic
ccuguucauuguaagcacuuuua

SEQ ID NO: 582 - DNA, 21 bp, Artificial
  Synthethic
aauuaccaagaauucuccaaa

SEQ ID NO: 583 - DNA, 23 bp, Artificial
  Synthethic
uuuggagaauucuugguaauuga

SEQ ID NO: 584 - RNA, 23 nt, Artificial
  Synthethic
ucaauuaccaagaauucuccaaa

SEQ ID NO: 585 - DNA, 21 bp, Artificial
  Synthethic
uuaccaagaauucuccaaaau

SEQ ID NO: 586 - DNA, 23 bp, Artificial
  Synthethic
auuuuggagaauucuugguaauu

SEQ ID NO: 587 - RNA, 23 nt, Artificial
  Synthethic
aauuaccaagaauucuccaaaac

SEQ ID NO: 588 - DNA, 21 bp, Artificial
  Synthethic
ucauugcuuaugacaugaucu

SEQ ID NO: 589 - DNA, 23 bp, Artificial
  Synthethic
agaucatgucauaagcaaugauu

SEQ ID NO: 590 - RNA, 23 nt, Artificial
  Synthethic
aaucauugcuuaugacaugaucg

SEQ ID NO: 591 - DNA, 21 bp, Artificial
  Synthethic
uuuuaagaugugucuucaauu

SEQ ID NO: 592 - DNA, 23 bp, Artificial
  Synthethic
aauugaagacacaucuuaaaaga

SEQ ID NO: 593 - RNA, 23 nt, Artificial
  Synthethic
ucuuuuaagaugugucuucaauu

SEQ ID NO: 594 - DNA, 21 bp, Artificial
  Synthethic
auccuguuaaacuuccuacaa

SEQ ID NO: 595 - DNA, 23 bp, Artificial
  Synthethic
uuguaggaaguuuaacaggaucu

SEQ ID NO: 596 - RNA, 23 nt, Artificial
  Synthethic
agauccuguuaaacuuccuacaa

SEQ ID NO: 597 - DNA, 21 bp, Artificial
  Synthethic
acuauucagaugacgucuugu

SEQ ID NO: 598 - DNA, 23 bp, Artificial
  Synthethic
acaagacgucaucugaauaguuu

SEQ ID NO: 599 - RNA, 23 nt, Artificial
  Synthethic
aaacuauucagaugacgucuugg

SEQ ID NO: 600 - DNA, 21 bp, Artificial
  Synthethic
guucaucaucaaaaauugguu

SEQ ID NO: 601 - DNA, 23 bp, Artificial
  Synthethic
aaccaatuuuugaugaugaacuu

SEQ ID NO: 602 - RNA, 23 nt, Artificial
  Synthethic
aaguucaucaucaaaaauuggug

SEQ ID NO: 603 - DNA, 21 bp, Artificial
  Synthethic
uaucucucuuuacauuuuggu

SEQ ID NO: 604 - DNA, 23 bp, Artificial
  Synthethic
accaaaauguaaagagagauaga

SEQ ID NO: 605 - RNA, 23 nt, Artificial
  Synthethic
ucuaucucucuuuacauuuuggu

SEQ ID NO: 606 - DNA, 21 bp, Artificial
  Synthethic
aucucucuuuacauuuugguu

SEQ ID NO: 607 - DNA, 23 bp, Artificial
  Synthethic
aaccaaaauguaaagagagauag

SEQ ID NO: 608 - RNA, 23 nt, Artificial
  Synthethic
cuaucucucuuuacauuuugguc

SEQ ID NO: 609 - DNA, 21 bp, Artificial
  Synthethic
uguguacuguaaagaauuuau

SEQ ID NO: 610 - DNA, 23 bp, Artificial
  Synthethic
auaaautcuuuacaguacacaaa

SEQ ID NO: 611 - RNA, 23 nt, Artificial
  Synthethic
uuuguguacuguaaagaauuuag

SEQ ID NO: 612 - DNA, 21 bp, Artificial
  Synthethic
cuacuuuacauaugcuuuaau

SEQ ID NO: 613 - DNA, 23 bp, Artificial
  Synthethic
auuaaagcauauguaaaguagga

SEQ ID NO: 614 - RNA, 23 nt, Artificial
  Synthethic
uccuacuuuacauaugcuuuaag

SEQ ID NO: 615 - DNA, 21 bp, Artificial
  Synthethic
ugccuaaguauuccuuuccuu

SEQ ID NO: 616 - DNA, 23 bp, Artificial
  Synthethic
aaggaaaggaauacuuaggcaag

SEQ ID NO: 617 - RNA, 23 nt, Artificial
  Synthethic
cuugccuaaguauuccuuuccug

SEQ ID NO: 618 - DNA, 21 bp, Artificial
  Synthethic
aaguauuccuuuccugaucau

SEQ ID NO: 619 - DNA, 23 bp, Artificial
  Synthethic
augaucaggaaaggaauacuuag

SEQ ID NO: 620 - RNA, 23 nt, Artificial
  Synthethic
cuaaguauuccuuuccugaucac

SEQ ID NO: 621 - DNA, 21 bp, Artificial
  Synthethic
guauuccuuuccugaucacua

SEQ ID NO: 622 - DNA, 23 bp, Artificial
  Synthethic
uagugatcaggaaaggaauacuu

SEQ ID NO: 623 - RNA, 23 nt, Artificial
  Synthethic
aaguauuccuuuccugaucacua

SEQ ID NO: 624 - DNA, 21 bp, Artificial
  Synthethic
uuccugaucacuaugcauuuu

SEQ ID NO: 625 - DNA, 23 bp, Artificial
  Synthethic
aaaaugcauagugaucaggaaag

SEQ ID NO: 626 - RNA, 23 nt, Artificial
  Synthethic
cuuuccugaucacuaugcauuuu

SEQ ID NO: 627 - DNA, 21 bp, Artificial
  Synthethic
cugaucacuaugcauuuuaaa

SEQ ID NO: 628 - DNA, 23 bp, Artificial
  Synthethic
uuuaaaaugcauagugaucagga

SEQ ID NO: 629 - RNA, 23 nt, Artificial
  Synthethic
uccugaucacuaugcauuuuaaa

SEQ ID NO: 630 - DNA, 21 bp, Artificial
  Synthethic
cacguaucuuugggucuuuga

SEQ ID NO: 631 - DNA, 23 bp, Artificial
  Synthethic
ucaaagacccaaagauacgugga

SEQ ID NO: 632 - RNA, 23 nt, Artificial
  Synthethic
uccacguaucuuugggucuuuga

SEQ ID NO: 633 - DNA, 21 bp, Artificial
  Synthethic
ugggucuuugauaaagaaaau

SEQ ID NO: 634 - DNA, 23 bp, Artificial
  Synthethic
auuuuctuuaucaaagacccaaa

SEQ ID NO: 635 - RNA, 23 nt, Artificial
  Synthethic
uuugggucuuugauaaagaaaag

SEQ ID NO: 636 - DNA, 21 bp, Artificial
  Synthethic
ucaauuaccaagaauucucca

SEQ ID NO: 637 - DNA, 23 bp, Artificial
  Synthethic
uggagaauucuugguaauugaag

SEQ ID NO: 638 - RNA, 23 nt, Artificial
  Synthethic
cuucaauuaccaagaauucucca

SEQ ID NO: 639 - DNA, 21 bp, Artificial
  Synthethic
ucgcuuucuacacuguauuau

SEQ ID NO: 640 - DNA, 23 bp, Artificial
  Synthethic
auaauacaguguagaaagcgauc

SEQ ID NO: 641 - RNA, 23 nt, Artificial
  Synthethic
gaucgcuuucuacacuguauuac

SEQ ID NO: 642 - DNA, 21 bp, Artificial
  Synthethic
auuuucuuuaaccagucugaa

SEQ ID NO: 643 - DNA, 23 bp, Artificial
  Synthethic
uucagacugguuaaagaaaauug

SEQ ID NO: 644 - RNA, 23 nt, Artificial
  Synthethic
caauuuucuuuaaccagucugaa

SEQ ID NO: 645 - DNA, 21 bp, Artificial
  Synthethic
cuuuaaccagucugaaguuuc

SEQ ID NO: 646 - DNA, 23 bp, Artificial
  Synthethic
gaaacutcagacugguuaaagaa

SEQ ID NO: 647 - RNA, 23 nt, Artificial
  Synthethic
uucuuuaaccagucugaaguuuc

SEQ ID NO: 648 - DNA, 21 bp, Artificial
  Synthethic
uaagaugugucuucaauuugu

SEQ ID NO: 649 - DNA, 23 bp, Artificial
  Synthethic
acaaautgaagacacaucuuaaa

SEQ ID NO: 650 - RNA, 23 nt, Artificial
  Synthethic
uuuaagaugugucuucaauuugu

SEQ ID NO: 651 - DNA, 21 bp, Artificial
  Synthethic
gauccuguuaaacuuccuaca

SEQ ID NO: 652 - DNA, 23 bp, Artificial
  Synthethic
uguaggaaguuuaacaggaucuc

SEQ ID NO: 653 - RNA, 23 nt, Artificial
  Synthethic
gagauccuguuaaacuuccuaca

SEQ ID NO: 654 - DNA, 21 bp, Artificial
  Synthethic
cugcuucagaaagagcaaaau

SEQ ID NO: 655 - DNA, 23 bp, Artificial
  Synthethic
auuuugcucuuucugaagcagcu

SEQ ID NO: 656 - RNA, 23 nt, Artificial
  Synthethic
agcugcuucagaaagagcaaaac

SEQ ID NO: 657 - DNA, 21 bp, Artificial
  Synthethic
cagaaagagcaaaacuauuca

SEQ ID NO: 658 - DNA, 23 bp, Artificial
  Synthethic
ugaauaguuuugcucuuucugaa

SEQ ID NO: 659 - RNA, 23 nt, Artificial
  Synthethic
uucagaaagagcaaaacuauuca

SEQ ID NO: 660 - DNA, 21 bp, Artificial
  Synthethic
uaugaaguucaucaucaaaaa

SEQ ID NO: 661 - DNA, 23 bp, Artificial
  Synthethic
uuuuugaugaugaacuucauauc

SEQ ID NO: 662 - RNA, 23 nt, Artificial
  Synthethic
gauaugaaguucaucaucaaaaa

SEQ ID NO: 663 - DNA, 21 bp, Artificial
  Synthethic
caucaucaaaaauugguguuu

SEQ ID NO: 664 - DNA, 23 bp, Artificial
  Synthethic
aaacaccaauuuuugaugaugaa

SEQ ID NO: 665 - RNA, 23 nt, Artificial
  Synthethic
uucaucaucaaaaauugguguuc

SEQ ID NO: 666 - DNA, 21 bp, Artificial
  Synthethic
ucaaaaauugguguucuuugu

SEQ ID NO: 667 - DNA, 23 bp, Artificial
  Synthethic
acaaagaacaccaauuuuugaug

SEQ ID NO: 668 - RNA, 23 nt, Artificial
  Synthethic
caucaaaaauugguguucuuugc

SEQ ID NO: 669 - DNA, 21 bp, Artificial
  Synthethic
aaaauccaaccuacaaguucu

SEQ ID NO: 670 - DNA, 23 bp, Artificial
  Synthethic
agaacutguagguuggauuuucg

SEQ ID NO: 671 - RNA, 23 nt, Artificial
  Synthethic
cgaaaauccaaccuacaaguucu

SEQ ID NO: 672 - DNA, 21 bp, Artificial
  Synthethic
ccaaccuacaaguucuuugau

SEQ ID NO: 673 - DNA, 23 bp, Artificial
  Synthethic
aucaaagaacuuguagguuggau

SEQ ID NO: 674 - RNA, 23 nt, Artificial
  Synthethic
auccaaccuacaaguucuuugag

SEQ ID NO: 675 - DNA, 21 bp, Artificial
  Synthethic
acucauuaucgccuuuugaca

SEQ ID NO: 676 - DNA, 23 bp, Artificial
  Synthethic
ugucaaaaggcgauaaugaguaa

SEQ ID NO: 677 - RNA, 23 nt, Artificial
  Synthethic
uuacucauuaucgccuuuugaca

SEQ ID NO: 678 - DNA, 21 bp, Artificial
  Synthethic
cucauuaucgccuuuugacau

SEQ ID NO: 679 - DNA, 23 bp, Artificial
  Synthethic
augucaaaaggcgauaaugagua

SEQ ID NO: 680 - RNA, 23 nt, Artificial
  Synthethic
uacucauuaucgccuuuugacag

SEQ ID NO: 681 - DNA, 21 bp, Artificial
  Synthethic
ugugcuguaacacaaguagau

SEQ ID NO: 682 - DNA, 23 bp, Artificial
  Synthethic
aucuactuguguuacagcacagc

SEQ ID NO: 683 - RNA, 23 nt, Artificial
  Synthethic
gcugugcuguaacacaaguagau

SEQ ID NO: 684 - DNA, 21 bp, Artificial
  Synthethic
gugcuguaacacaaguagauu

SEQ ID NO: 685 - DNA, 23 bp, Artificial
  Synthethic
aaucuacuuguguuacagcacag

SEQ ID NO: 686 - RNA, 23 nt, Artificial
  Synthethic
cugugcuguaacacaaguagaug

SEQ ID NO: 687 - DNA, 21 bp, Artificial
  Synthethic
ucuuuacauuuuggucucuau

SEQ ID NO: 688 - DNA, 23 bp, Artificial
  Synthethic
auagagaccaaaauguaaagaga

SEQ ID NO: 689 - RNA, 23 nt, Artificial
  Synthethic
ucucuuuacauuuuggucucuau

SEQ ID NO: 690 - DNA, 21 bp, Artificial
  Synthethic
auggguuuuguguacuguaaa

SEQ ID NO: 691 - DNA, 23 bp, Artificial
  Synthethic
uuuacaguacacaaaacccauua

SEQ ID NO: 692 - RNA, 23 nt, Artificial
  Synthethic
uaauggguuuuguguacuguaaa

SEQ ID NO: 693 - DNA, 21 bp, Artificial
  Synthethic
uuguguacuguaaagaauuua

SEQ ID NO: 694 - DNA, 23 bp, Artificial
  Synthethic
uaaauucuuuacaguacacaaaa

SEQ ID NO: 695 - RNA, 23 nt, Artificial
  Synthethic
uuuuguguacuguaaagaauuua

SEQ ID NO: 696 - DNA, 21 bp, Artificial
  Synthethic
gcuguaucaaacuagugcauu

SEQ ID NO: 697 - DNA, 23 bp, Artificial
  Synthethic
aaugcacuaguuugauacagcua

SEQ ID NO: 698 - RNA, 23 nt, Artificial
  Synthethic
uagcuguaucaaacuagugcaug

SEQ ID NO: 699 - DNA, 21 bp, Artificial
  Synthethic
cuagugcaugaauagauucuu

SEQ ID NO: 700 - DNA, 23 bp, Artificial
  Synthethic
aagaaucuauucaugcacuaguu

SEQ ID NO: 701 - RNA, 23 nt, Artificial
  Synthethic
aacuagugcaugaauagauucuc

SEQ ID NO: 702 - DNA, 21 bp, Artificial
  Synthethic
uagugcaugaauagauucucu

SEQ ID NO: 703 - DNA, 23 bp, Artificial
  Synthethic
agagaatcuauucaugcacuagu

SEQ ID NO: 704 - RNA, 23 nt, Artificial
  Synthethic
acuagugcaugaauagauucucu

SEQ ID NO: 705 - DNA, 21 bp, Artificial
  Synthethic
cucuccugauuauuuaucaca

SEQ ID NO: 706 - DNA, 23 bp, Artificial
  Synthethic
ugugauaaauaaucaggagagaa

SEQ ID NO: 707 - RNA, 23 nt, Artificial
  Synthethic
uucucuccugauuauuuaucaca

SEQ ID NO: 708 - DNA, 21 bp, Artificial
  Synthethic
ccugauuauuuaucacauagu

SEQ ID NO: 709 - DNA, 23 bp, Artificial
  Synthethic
acuaugtgauaaauaaucaggag

SEQ ID NO: 710 - RNA, 23 nt, Artificial
  Synthethic
cuccugauuauuuaucacauagc

SEQ ID NO: 711 - DNA, 21 bp, Artificial
  Synthethic
uaaguccuacuuuacauaugu

SEQ ID NO: 712 - DNA, 23 bp, Artificial
  Synthethic
acauauguaaaguaggacuuaau

SEQ ID NO: 713 - RNA, 23 nt, Artificial
  Synthethic
auuaaguccuacuuuacauaugc

SEQ ID NO: 714 - DNA, 21 bp, Artificial
  Synthethic
aguccuacuuuacauaugcuu

SEQ ID NO: 715 - DNA, 23 bp, Artificial
  Synthethic
aagcauauguaaaguaggacuua

SEQ ID NO: 716 - RNA, 23 nt, Artificial
  Synthethic
uaaguccuacuuuacauaugcuu

SEQ ID NO: 717 - DNA, 21 bp, Artificial
  Synthethic
guccuacuuuacauaugcuuu

SEQ ID NO: 718 - DNA, 23 bp, Artificial
  Synthethic
aaagcatauguaaaguaggacuu

SEQ ID NO: 719 - RNA, 23 nt, Artificial
  Synthethic
aaguccuacuuuacauaugcuuu

SEQ ID NO: 720 - DNA, 21 bp, Artificial
  Synthethic
uucucuugccuaaguauuccu

SEQ ID NO: 721 - DNA, 23 bp, Artificial
  Synthethic
aggaauacuuaggcaagagaagc

SEQ ID NO: 722 - RNA, 23 nt, Artificial
  Synthethic
gcuucucuugccuaaguauuccu

SEQ ID NO: 723 - DNA, 21 bp, Artificial
  Synthethic
cucuugccuaaguauuccuuu

SEQ ID NO: 724 - DNA, 23 bp, Artificial
  Synthethic
aaaggaauacuuaggcaagagaa

SEQ ID NO: 725 - RNA, 23 nt, Artificial
  Synthethic
uucucuugccuaaguauuccuuu

SEQ ID NO: 726 - DNA, 21 bp, Artificial
  Synthethic
uauuccuuuccugaucacuau

SEQ ID NO: 727 - DNA, 23 bp, Artificial
  Synthethic
auagugaucaggaaaggaauacu

SEQ ID NO: 728 - RNA, 23 nt, Artificial
  Synthethic
aguauuccuuuccugaucacuau

SEQ ID NO: 729 - DNA, 21 bp, Artificial
  Synthethic
uuuccugaucacuaugcauuu

SEQ ID NO: 730 - DNA, 23 bp, Artificial
  Synthethic
aaaugcauagugaucaggaaagg

SEQ ID NO: 731 - RNA, 23 nt, Artificial
  Synthethic
ccuuuccugaucacuaugcauuu

SEQ ID NO: 732 - DNA, 21 bp, Artificial
  Synthethic
cacuaugcauuuuaaaguuaa

SEQ ID NO: 733 - DNA, 23 bp, Artificial
  Synthethic
uuaacutuaaaaugcauagugau

SEQ ID NO: 734 - RNA, 23 nt, Artificial
  Synthethic
aucacuaugcauuuuaaaguuaa

SEQ ID NO: 735 - DNA, 21 bp, Artificial
  Synthethic
cugcauuuuacuguacagauu

SEQ ID NO: 736 - DNA, 23 bp, Artificial
  Synthethic
aaucugtacaguaaaaugcaguc

SEQ ID NO: 737 - RNA, 23 nt, Artificial
  Synthethic
gacugcauuuuacuguacagauu

SEQ ID NO: 738 - DNA, 21 bp, Artificial
  Synthethic
uucugcuauauuugugauaua

SEQ ID NO: 739 - DNA, 23 bp, Artificial
  Synthethic
uauaucacaaauauagcagaagc

SEQ ID NO: 740 - RNA, 23 nt, Artificial
  Synthethic
gcuucugcuauauuugugauaua

SEQ ID NO: 741 - DNA, 21 bp, Artificial
  Synthethic
ucugcuauauuugugauauau

SEQ ID NO: 742 - DNA, 23 bp, Artificial
  Synthethic
auauaucacaaauauagcagaag

SEQ ID NO: 743 - RNA, 23 nt, Artificial
  Synthethic
cuucugcuauauuugugauauag

SEQ ID NO: 744 - DNA, 21 bp, Artificial
  Synthethic
acguaucuuugggucuuugau

SEQ ID NO: 745 - DNA, 23 bp, Artificial
  Synthethic
aucaaagacccaaagauacgugg

SEQ ID NO: 746 - RNA, 23 nt, Artificial
  Synthethic
ccacguaucuuugggucuuugau

SEQ ID NO: 747 - DNA, 21 bp, Artificial
  Synthethic
ucuuugggucuuugauaaaga

SEQ ID NO: 748 - DNA, 23 bp, Artificial
  Synthethic
ucuuuatcaaagacccaaagaua

SEQ ID NO: 749 - RNA, 23 nt, Artificial
  Synthethic
uaucuuugggucuuugauaaaga

SEQ ID NO: 750 - DNA, 21 bp, Artificial
  Synthethic
cuuugggucuuugauaaagaa

SEQ ID NO: 751 - DNA, 23 bp, Artificial
  Synthethic
uucuuuaucaaagacccaaagau

SEQ ID NO: 752 - RNA, 23 nt, Artificial
  Synthethic
aucuuugggucuuugauaaagaa

SEQ ID NO: 753 - DNA, 21 bp, Artificial
  Synthethic
uugggucuuugauaaagaaaa

SEQ ID NO: 754 - DNA, 23 bp, Artificial
  Synthethic
uuuucutuaucaaagacccaaag

SEQ ID NO: 755 - RNA, 23 nt, Artificial
  Synthethic
cuuugggucuuugauaaagaaaa

SEQ ID NO: 756 - DNA, 21 bp, Artificial
  Synthethic
agaaucccuguucauuguaau

SEQ ID NO: 757 - DNA, 23 bp, Artificial
  Synthethic
auuacaaugaacagggauucuuu

SEQ ID NO: 758 - RNA, 23 nt, Artificial
  Synthethic
aaagaaucccuguucauuguaag

SEQ ID NO: 759 - DNA, 21 bp, Artificial
  Synthethic
gaaucccuguucauuguaagu

SEQ ID NO: 760 - DNA, 23 bp, Artificial
  Synthethic
acuuacaaugaacagggauucuu

SEQ ID NO: 761 - RNA, 23 nt, Artificial
  Synthethic
aagaaucccuguucauuguaagc

SEQ ID NO: 762 - DNA, 21 bp, Artificial
  Synthethic
guucauuguaagcacuuuuau

SEQ ID NO: 763 - DNA, 23 bp, Artificial
  Synthethic
auaaaagugcuuacaaugaacag

SEQ ID NO: 764 - RNA, 23 nt, Artificial
  Synthethic
cuguucauuguaagcacuuuuac

SEQ ID NO: 765 - DNA, 21 bp, Artificial
  Synthethic
uuaugacaugaucgcuuucua

SEQ ID NO: 766 - DNA, 23 bp, Artificial
  Synthethic
uagaaagcgaucaugucauaagc

SEQ ID NO: 767 - RNA, 23 nt, Artificial
  Synthethic
gcuuaugacaugaucgcuuucua

SEQ ID NO: 768 - DNA, 21 bp, Artificial
  Synthethic
augacaugaucgcuuucuaca

SEQ ID NO: 769 - DNA, 23 bp, Artificial
  Synthethic
uguagaaagcgaucaugucauaa

SEQ ID NO: 770 - RNA, 23 nt, Artificial
  Synthethic
uuaugacaugaucgcuuucuaca

SEQ ID NO: 771 - DNA, 21 bp, Artificial
  Synthethic
caugaucgcuuucuacacugu

SEQ ID NO: 772 - DNA, 23 bp, Artificial
  Synthethic
acagugtagaaagcgaucauguc

SEQ ID NO: 773 - RNA, 23 nt, Artificial
  Synthethic
gacaugaucgcuuucuacacugu

SEQ ID NO: 774 - DNA, 21 bp, Artificial
  Synthethic
cuuucuacacuguauuacaua

SEQ ID NO: 775 - DNA, 23 bp, Artificial
  Synthethic
uauguaauacaguguagaaagcg

SEQ ID NO: 776 - RNA, 23 nt, Artificial
  Synthethic
cgcuuucuacacuguauuacaua

SEQ ID NO: 777 - DNA, 21 bp, Artificial
  Synthethic
gauucaauuuucuuuaaccau

SEQ ID NO: 778 - DNA, 23 bp, Artificial
  Synthethic
augguuaaagaaaauugaaucug

SEQ ID NO: 779 - RNA, 23 nt, Artificial
  Synthethic
cagauucaauuuucuuuaaccag

SEQ ID NO: 780 - DNA, 21 bp, Artificial
  Synthethic
uuucuuuaaccagucugaagu

SEQ ID NO: 781 - DNA, 23 bp, Artificial
  Synthethic
acuucagacugguuaaagaaaau

SEQ ID NO: 782 - RNA, 23 nt, Artificial
  Synthethic
auuuucuuuaaccagucugaagu

SEQ ID NO: 783 - DNA, 21 bp, Artificial
  Synthethic
uuuaagaugugucuucaauuu

SEQ ID NO: 784 - DNA, 23 bp, Artificial
  Synthethic
aaauugaagacacaucuuaaaag

SEQ ID NO: 785 - RNA, 23 nt, Artificial
  Synthethic
cuuuuaagaugugucuucaauuu

SEQ ID NO: 786 - DNA, 21 bp, Artificial
  Synthethic
uuaagaugugucuucaauuug

SEQ ID NO: 787 - DNA, 23 bp, Artificial
  Synthethic
caaauugaagacacaucuuaaaa

SEQ ID NO: 788 - RNA, 23 nt, Artificial
  Synthethic
uuuuaagaugugucuucaauuug

SEQ ID NO: 789 - DNA, 21 bp, Artificial
  Synthethic
agaugugucuucaauuuguau

SEQ ID NO: 790 - DNA, 23 bp, Artificial
  Synthethic
auacaaauugaagacacaucuua

SEQ ID NO: 791 - RNA, 23 nt, Artificial
  Synthethic
uaagaugugucuucaauuuguau

SEQ ID NO: 792 - DNA, 21 bp, Artificial
  Synthethic
ugucuucaauuuguauaaaau

SEQ ID NO: 793 - DNA, 23 bp, Artificial
  Synthethic
auuuuatacaaauugaagacaca

SEQ ID NO: 794 - RNA, 23 nt, Artificial
  Synthethic
ugugucuucaauuuguauaaaau

SEQ ID NO: 795 - DNA, 21 bp, Artificial
  Synthethic
cuucaauuuguauaaaauggu

SEQ ID NO: 796 - DNA, 23 bp, Artificial
  Synthethic
accauutuauacaaauugaagac

SEQ ID NO: 797 - RNA, 23 nt, Artificial
  Synthethic
gucuucaauuuguauaaaauggu

SEQ ID NO: 798 - DNA, 21 bp, Artificial
  Synthethic
augguguuuucauguaaauaa

SEQ ID NO: 799 - DNA, 23 bp, Artificial
  Synthethic
uuauuuacaugaaaacaccauuu

SEQ ID NO: 800 - RNA, 23 nt, Artificial
  Synthethic
aaaugguguuuucauguaaauaa

SEQ ID NO: 801 - DNA, 21 bp, Artificial
  Synthethic
uucuuuuaagaugugucuuca

SEQ ID NO: 802 - DNA, 23 bp, Artificial
  Synthethic
ugaagacacaucuuaaaagaagg

SEQ ID NO: 803 - RNA, 23 nt, Artificial
  Synthethic
ccuucuuuuaagaugugucuuca

SEQ ID NO: 804 - DNA, 21 bp, Artificial
  Synthethic
uguauucuaucucucuuuaca

SEQ ID NO: 805 - DNA, 23 bp, Artificial
  Synthethic
uguaaagagagauagaauacauu

SEQ ID NO: 806 - RNA, 23 nt, Artificial
  Synthethic
aauguauucuaucucucuuuaca

SEQ ID NO: 807 - DNA, 21 bp, Artificial
  Synthethic
gucucuauacuacauuauuaa

SEQ ID NO: 808 - DNA, 23 bp, Artificial
  Synthethic
uuaauaauguaguauagagacca

SEQ ID NO: 809 - RNA, 23 nt, Artificial
  Synthethic
uggucucuauacuacauuauuaa

SEQ ID NO: 810 - DNA, 21 bp, Artificial
  Synthethic
ucucuauacuacauuauuaau

SEQ ID NO: 811 - DNA, 23 bp, Artificial
  Synthethic
auuaauaauguaguauagagacc

SEQ ID NO: 812 - RNA, 23 nt, Artificial
  Synthethic
ggucucuauacuacauuauuaau

SEQ ID NO: 813 - DNA, 21 bp, Artificial
  Synthethic
cucuauacuacauuauuaauu

SEQ ID NO: 814 - DNA, 23 bp, Artificial
  Synthethic
aauuaataauguaguauagagac

SEQ ID NO: 815 - RNA, 23 nt, Artificial
  Synthethic
gucucuauacuacauuauuaaug

SEQ ID NO: 816 - DNA, 21 bp, Artificial
  Synthethic
cuucaauuaccaagaauucuu

SEQ ID NO: 817 - DNA, 23 bp, Artificial
  Synthethic
aagaautcuugguaauugaagac

SEQ ID NO: 818 - RNA, 23 nt, Artificial
  Synthethic
gucuucaauuaccaagaauucuc

SEQ ID NO: 819 - DNA, 21 bp, Artificial
  Synthethic
ccacacaucaguaauguauuu

SEQ ID NO: 820 - DNA, 23 bp, Artificial
  Synthethic
aaauacauuacugauguguggau

SEQ ID NO: 821 - RNA, 23 nt, Artificial
  Synthethic
auccacacaucaguaauguauuc

SEQ ID NO: 822 - DNA, 21 bp, Artificial
  Synthethic
cuaucucucuuuacauuuugu

SEQ ID NO: 823 - DNA, 23 bp, Artificial
  Synthethic
acaaaatguaaagagagauagaa

SEQ ID NO: 824 - RNA, 23 nt, Artificial
  Synthethic
uucuaucucucuuuacauuuugg

SEQ ID NO: 825 - DNA, 21 bp, Artificial
  Synthethic
ggucucuauacuacauuauua

SEQ ID NO: 826 - DNA, 23 bp, Artificial
  Synthethic
uaauaatguaguauagagaccaa

SEQ ID NO: 827 - RNA, 23 nt, Artificial
  Synthethic
uuggucucuauacuacauuauua

SEQ ID NO: 828 - DNA, 21 bp, Artificial
  Synthethic
ucuauacuacauuauuaaugu

SEQ ID NO: 829 - DNA, 23 bp, Artificial
  Synthethic
acauuaauaauguaguauagaga

SEQ ID NO: 830 - RNA, 23 nt, Artificial
  Synthethic
ucucuauacuacauuauuaaugg

SEQ ID NO: 831 - DNA, 21 bp, Artificial
  Synthethic
ggucuucaauuaccaagaauu

SEQ ID NO: 832 - DNA, 23 bp, Artificial
  Synthethic
aauucutgguaauugaagaccag

SEQ ID NO: 833 - RNA, 23 nt, Artificial
  Synthethic
cuggucuucaauuaccaagaauu

SEQ ID NO: 834 - DNA, 21 bp, Artificial
  Synthethic
caggauaugaaguucaucauu

SEQ ID NO: 835 - DNA, 23 bp, Artificial
  Synthethic
aaugaugaacuucauauccugag

SEQ ID NO: 836 - RNA, 23 nt, Artificial
  Synthethic
cucaggauaugaaguucaucauc

SEQ ID NO: 837 - DNA, 21 bp, Artificial
  Synthethic
acacaucaguaauguauucua

SEQ ID NO: 838 - DNA, 23 bp, Artificial
  Synthethic
uagaauacauuacugaugugugg

SEQ ID NO: 839 - RNA, 23 nt, Artificial
  Synthethic
ccacacaucaguaauguauucua

SEQ ID NO: 840 - DNA, 21 bp, Artificial
  Synthethic
cuauacuacauuauuaauggu

SEQ ID NO: 841 - DNA, 23 bp, Artificial
  Synthethic
accauuaauaauguaguauagag

SEQ ID NO: 842 - RNA, 23 nt, Artificial
  Synthethic
cucuauacuacauuauuaauggg

SEQ ID NO: 843 - DNA, 21 bp, Artificial
  Synthethic
cccguuuuaugauuuacucau

SEQ ID NO: 844 - DNA, 23 bp, Artificial
  Synthethic
augaguaaaucauaaaacggguu

SEQ ID NO: 845 - RNA, 23 nt, Artificial
  Synthethic
aacccguuuuaugauuuacucau

SEQ ID NO: 846 - DNA, 21 bp, Artificial
  Synthethic
uuccaugacugcauuuuacuu

SEQ ID NO: 847 - DNA, 23 bp, Artificial
  Synthethic
aaguaaaaugcagucauggaaaa

SEQ ID NO: 848 - RNA, 23 nt, Artificial
  Synthethic
uuuuccaugacugcauuuuacug

SEQ ID NO: 849 - DNA, 21 bp, Artificial
  Synthethic
ucuucaauuaccaagaauucu

SEQ ID NO: 850 - DNA, 23 bp, Artificial
  Synthethic
agaauucuugguaauugaagacc

SEQ ID NO: 851 - RNA, 23 nt, Artificial
  Synthethic
ggucuucaauuaccaagaauucu

SEQ ID NO: 852 - DNA, 21 bp, Artificial
  Synthethic
cugaaguuucauuuaugauau

SEQ ID NO: 853 - DNA, 23 bp, Artificial
  Synthethic
auaucataaaugaaacuucagac

SEQ ID NO: 854 - RNA, 23 nt, Artificial
  Synthethic
gucugaaguuucauuuaugauac

SEQ ID NO: 855 - DNA, 21 bp, Artificial
  Synthethic
gcgccaugucccaaaguuuau

SEQ ID NO: 856 - DNA, 23 bp, Artificial
  Synthethic
auaaactuugggacauggcgcug

SEQ ID NO: 857 - DNA, 21 bp, Artificial
  Synthethic
cuugcccgagauccuguuaaa

SEQ ID NO: 858 - DNA, 23 bp, Artificial
  Synthethic
uuuaacaggaucucgggcaagag

SEQ ID NO: 859 - DNA, 21 bp, Artificial
  Synthethic
uugcccgagauccuguuaaau

SEQ ID NO: 860 - DNA, 23 bp, Artificial
  Synthethic
auuuaacaggaucucgggcaaga

SEQ ID NO: 861 - DNA, 21 bp, Artificial
  Synthethic
ugcccgagauccuguuaaacu

SEQ ID NO: 862 - DNA, 23 bp, Artificial
  Synthethic
aguuuaacaggaucucgggcaag

SEQ ID NO: 863 - DNA, 21 bp, Artificial
  Synthethic
gauccuguuaaacuuccuaca

SEQ ID NO: 864 - DNA, 23 bp, Artificial
  Synthethic
uguaggaaguuuaacaggaucuc

SEQ ID NO: 865 - DNA, 21 bp, Artificial
  Synthethic
auccuguuaaacuuccuacaa

SEQ ID NO: 866 - DNA, 23 bp, Artificial
  Synthethic
uuguaggaaguuuaacaggaucu

SEQ ID NO: 867 - DNA, 21 bp, Artificial
  Synthethic
cugcuucagaaagagcaaaau

SEQ ID NO: 868 - DNA, 23 bp, Artificial
  Synthethic
auuuugcucuuucugaagcagcu

SEQ ID NO: 869 - DNA, 21 bp, Artificial
  Synthethic
cagaaagagcaaaacuauuca

SEQ ID NO: 870 - DNA, 23 bp, Artificial
  Synthethic
ugaauaguuuugcucuuucugaa

SEQ ID NO: 871 - DNA, 21 bp, Artificial
  Synthethic
gagcaaaacuauucagaugau

SEQ ID NO: 872 - DNA, 23 bp, Artificial
  Synthethic
aucauctgaauaguuuugcucuu

SEQ ID NO: 873 - DNA, 21 bp, Artificial
  Synthethic
aaaacuauucagaugacgucu

SEQ ID NO: 874 - DNA, 23 bp, Artificial
  Synthethic
agacgucaucugaauaguuuugc

SEQ ID NO: 875 - DNA, 21 bp, Artificial
  Synthethic
aaacuauucagaugacgucuu

SEQ ID NO: 876 - DNA, 23 bp, Artificial
  Synthethic
aagacgtcaucugaauaguuuug

SEQ ID NO: 877 - DNA, 21 bp, Artificial
  Synthethic
acuauucagaugacgucuugu

SEQ ID NO: 878 - DNA, 23 bp, Artificial
  Synthethic
acaagacgucaucugaauaguuu

SEQ ID NO: 879 - DNA, 21 bp, Artificial
  Synthethic
uucagaugacgucuuggccaa

SEQ ID NO: 880 - DNA, 23 bp, Artificial
  Synthethic
uuggccaagacgucaucugaaua

SEQ ID NO: 881 - DNA, 21 bp, Artificial
  Synthethic
ggccaacaugauuagugaacu

SEQ ID NO: 882 - DNA, 23 bp, Artificial
  Synthethic
aguucacuaaucauguuggccaa

SEQ ID NO: 883 - DNA, 21 bp, Artificial
  Synthethic
ccaacaugauuagugaaccaa

SEQ ID NO: 884 - DNA, 23 bp, Artificial
  Synthethic
uugguucacuaaucauguuggcc

SEQ ID NO: 885 - DNA, 21 bp, Artificial
  Synthethic
augauuagugaaccaaggauu

SEQ ID NO: 886 - DNA, 23 bp, Artificial
  Synthethic
aauccutgguucacuaaucaugu

SEQ ID NO: 887 - DNA, 21 bp, Artificial
  Synthethic
auuagugaaccaaggaucagu

SEQ ID NO: 888 - DNA, 23 bp, Artificial
  Synthethic
acugauccuugguucacuaauca

SEQ ID NO: 889 - DNA, 21 bp, Artificial
  Synthethic
uuagugaaccaaggaucaguu

SEQ ID NO: 890 - DNA, 23 bp, Artificial
  Synthethic
aacugatccuugguucacuaauc

SEQ ID NO: 891 - DNA, 21 bp, Artificial
  Synthethic
agugaaccaaggaucaguuau

SEQ ID NO: 892 - DNA, 23 bp, Artificial
  Synthethic
auaacugauccuugguucacuaa

SEQ ID NO: 893 - DNA, 21 bp, Artificial
  Synthethic
ugaaccaaggaucaguuacgu

SEQ ID NO: 894 - DNA, 23 bp, Artificial
  Synthethic
acguaacugauccuugguucacu

SEQ ID NO: 895 - DNA, 21 bp, Artificial
  Synthethic
gaaccaaggaucaguuacgga

SEQ ID NO: 896 - DNA, 23 bp, Artificial
  Synthethic
uccguaacugauccuugguucac

SEQ ID NO: 897 - DNA, 21 bp, Artificial
  Synthethic
aaccaaggaucaguuacggaa

SEQ ID NO: 898 - DNA, 23 bp, Artificial
  Synthethic
uuccguaacugauccuugguuca

SEQ ID NO: 899 - DNA, 21 bp, Artificial
  Synthethic
caaggaucaguuacggaaacu

SEQ ID NO: 900 - DNA, 23 bp, Artificial
  Synthethic
aguuuccguaacugauccuuggu

SEQ ID NO: 901 - DNA, 21 bp, Artificial
  Synthethic
aaggaucaguuacggaaacga

SEQ ID NO: 902 - DNA, 23 bp, Artificial
  Synthethic
ucguuuccguaacugauccuugg

SEQ ID NO: 903 - DNA, 21 bp, Artificial
  Synthethic
ggaucaguuacggaaacgauu

SEQ ID NO: 904 - DNA, 23 bp, Artificial
  Synthethic
aaucgutuccguaacugauccuu

SEQ ID NO: 905 - DNA, 21 bp, Artificial
  Synthethic
gaucaguuacggaaacgaugu

SEQ ID NO: 906 - DNA, 23 bp, Artificial
  Synthethic
acaucgtuuccguaacugauccu

SEQ ID NO: 907 - DNA, 21 bp, Artificial
  Synthethic
aucaguuacggaaacgaugcu

SEQ ID NO: 908 - DNA, 23 bp, Artificial
  Synthethic
agcaucguuuccguaacugaucc

SEQ ID NO: 909 - DNA, 21 bp, Artificial
  Synthethic
ucaguuacggaaacgaugcuu

SEQ ID NO: 910 - DNA, 23 bp, Artificial
  Synthethic
aagcaucguuuccguaacugauc

SEQ ID NO: 911 - DNA, 21 bp, Artificial
  Synthethic
caguuacggaaacgaugcucu

SEQ ID NO: 912 - DNA, 23 bp, Artificial
  Synthethic
agagcatcguuuccguaacugau

SEQ ID NO: 913 - DNA, 21 bp, Artificial
  Synthethic
guuacggaaacgaugcucuca

SEQ ID NO: 914 - DNA, 23 bp, Artificial
  Synthethic
ugagagcaucguuuccguaacug

SEQ ID NO: 915 - DNA, 21 bp, Artificial
  Synthethic
uacggaaacgaugcucucauu

SEQ ID NO: 916 - DNA, 23 bp, Artificial
  Synthethic
aaugagagcaucguuuccguaac

SEQ ID NO: 917 - DNA, 21 bp, Artificial
  Synthethic
cucaugccaucuuugaccgaa

SEQ ID NO: 918 - DNA, 23 bp, Artificial
  Synthethic
uucggucaaagauggcaugagag

SEQ ID NO: 919 - DNA, 21 bp, Artificial
  Synthethic
ucaugccaucuuugaccgaaa

SEQ ID NO: 920 - DNA, 23 bp, Artificial
  Synthethic
uuucggtcaaagauggcaugaga

SEQ ID NO: 921 - DNA, 21 bp, Artificial
  Synthethic
caugccaucuuugaccgaaau

SEQ ID NO: 922 - DNA, 23 bp, Artificial
  Synthethic
auuucggucaaagauggcaugag

SEQ ID NO: 923 - DNA, 21 bp, Artificial
  Synthethic
augccaucuuugaccgaaacu

SEQ ID NO: 924 - DNA, 23 bp, Artificial
  Synthethic
aguuucggucaaagauggcauga

SEQ ID NO: 925 - DNA, 21 bp, Artificial
  Synthethic
gccaucuuugaccgaaacgaa

SEQ ID NO: 926 - DNA, 23 bp, Artificial
  Synthethic
uucguutcggucaaagauggcau

SEQ ID NO: 927 - DNA, 21 bp, Artificial
  Synthethic
ccaucuuugaccgaaacgaaa

SEQ ID NO: 928 - DNA, 23 bp, Artificial
  Synthethic
uuucgutucggucaaagauggca

SEQ ID NO: 929 - DNA, 21 bp, Artificial
  Synthethic
ucuuugaccgaaacgaaaacu

SEQ ID NO: 930 - DNA, 23 bp, Artificial
  Synthethic
aguuuucguuucggucaaagaug

SEQ ID NO: 931 - DNA, 21 bp, Artificial
  Synthethic
cuucccgugaauggagaguuu

SEQ ID NO: 932 - DNA, 23 bp, Artificial
  Synthethic
aaacuctccauucacgggaagga

SEQ ID NO: 933 - DNA, 21 bp, Artificial
  Synthethic
caacacagaaaacgaaguuga

SEQ ID NO: 934 - DNA, 23 bp, Artificial
  Synthethic
ucaacutcguuuucuguguuggc

SEQ ID NO: 935 - DNA, 21 bp, Artificial
  Synthethic
agguucuggguugacaaauau

SEQ ID NO: 936 - DNA, 23 bp, Artificial
  Synthethic
auauuugucaacccagaaccugg

SEQ ID NO: 937 - DNA, 21 bp, Artificial
  Synthethic
guucuggguugacaaauauca

SEQ ID NO: 938 - DNA, 23 bp, Artificial
  Synthethic
ugauautugucaacccagaaccu

SEQ ID NO: 939 - DNA, 21 bp, Artificial
  Synthethic
cuggguugacaaauaucaaga

SEQ ID NO: 940 - DNA, 23 bp, Artificial
  Synthethic
ucuugatauuugucaacccagaa

SEQ ID NO: 941 - DNA, 21 bp, Artificial
  Synthethic
uggguugacaaauaucaagau

SEQ ID NO: 942 - DNA, 23 bp, Artificial
  Synthethic
aucuugauauuugucaacccaga

SEQ ID NO: 943 - DNA, 21 bp, Artificial
  Synthethic
uggaugcagaauuccgacauu

SEQ ID NO: 944 - DNA, 23 bp, Artificial
  Synthethic
aaugucggaauucugcauccauc

SEQ ID NO: 945 - DNA, 21 bp, Artificial
  Synthethic
gaugcagaauuccgacaugau

SEQ ID NO: 946 - DNA, 23 bp, Artificial
  Synthethic
aucaugtcggaauucugcaucca

SEQ ID NO: 947 - DNA, 21 bp, Artificial
  Synthethic
caggauaugaaguucaucauu

SEQ ID NO: 948 - DNA, 23 bp, Artificial
  Synthethic
aaugaugaacuucauauccugag

SEQ ID NO: 949 - DNA, 21 bp, Artificial
  Synthethic
uaugaaguucaucaucaaaaa

SEQ ID NO: 950 - DNA, 23 bp, Artificial
  Synthethic
uuuuugaugaugaacuucauauc

SEQ ID NO: 951 - DNA, 21 bp, Artificial
  Synthethic
guucaucaucaaaaauugguu

SEQ ID NO: 952 - DNA, 23 bp, Artificial
  Synthethic
aaccaatuuuugaugaugaacuu

SEQ ID NO: 953 - DNA, 21 bp, Artificial
  Synthethic
caucaucaaaaauugguguuu

SEQ ID NO: 954 - DNA, 23 bp, Artificial
  Synthethic
aaacaccaauuuuugaugaugaa

SEQ ID NO: 955 - DNA, 21 bp, Artificial
  Synthethic
caucaaaaauugguguucuuu

SEQ ID NO: 956 - DNA, 23 bp, Artificial
  Synthethic
aaagaacaccaauuuuugaugau

SEQ ID NO: 957 - DNA, 21 bp, Artificial
  Synthethic
aucaaaaauugguguucuuug

SEQ ID NO: 958 - DNA, 23 bp, Artificial
  Synthethic
caaagaacaccaauuuuugauga

SEQ ID NO: 959 - DNA, 21 bp, Artificial
  Synthethic
ucaaaaauugguguucuuugu

SEQ ID NO: 960 - DNA, 23 bp, Artificial
  Synthethic
acaaagaacaccaauuuuugaug

SEQ ID NO: 961 - DNA, 21 bp, Artificial
  Synthethic
agaagauguggguucaaacaa

SEQ ID NO: 962 - DNA, 23 bp, Artificial
  Synthethic
uuguuugaacccacaucuucugc

SEQ ID NO: 963 - DNA, 21 bp, Artificial
  Synthethic
aagauguggguucaaacaaau

SEQ ID NO: 964 - DNA, 23 bp, Artificial
  Synthethic
auuugutugaacccacaucuucu

SEQ ID NO: 965 - DNA, 21 bp, Artificial
  Synthethic
uggguucaaacaaaggugcaa

SEQ ID NO: 966 - DNA, 23 bp, Artificial
  Synthethic
uugcaccuuuguuugaacccaca

SEQ ID NO: 967 - DNA, 21 bp, Artificial
  Synthethic
gguucaaacaaaggugcaauu

SEQ ID NO: 968 - DNA, 23 bp, Artificial
  Synthethic
aauugcaccuuuguuugaaccca

SEQ ID NO: 969 - DNA, 21 bp, Artificial
  Synthethic
gucauagcgacagugaucguu

SEQ ID NO: 970 - DNA, 23 bp, Artificial
  Synthethic
aacgaucacugucgcuaugacaa

SEQ ID NO: 971 - DNA, 21 bp, Artificial
  Synthethic
auagcgacagugaucgucauu

SEQ ID NO: 972 - DNA, 23 bp, Artificial
  Synthethic
aaugacgaucacugucgcuauga

SEQ ID NO: 973 - DNA, 21 bp, Artificial
  Synthethic
cagugaucgucaucaccuugu

SEQ ID NO: 974 - DNA, 23 bp, Artificial
  Synthethic
acaaggtgaugacgaucacuguc

SEQ ID NO: 975 - DNA, 21 bp, Artificial
  Synthethic
cugaagaagaaacaguacaca

SEQ ID NO: 976 - DNA, 23 bp, Artificial
  Synthethic
uguguacuguuucuucuucagca

SEQ ID NO: 977 - DNA, 21 bp, Artificial
  Synthethic
caguacacauccauucaucau

SEQ ID NO: 978 - DNA, 23 bp, Artificial
  Synthethic
augaugaauggauguguacuguu

SEQ ID NO: 979 - DNA, 21 bp, Artificial
  Synthethic
guccaagaugcagcagaacgu

SEQ ID NO: 980 - DNA, 23 bp, Artificial
  Synthethic
acguuctgcugcaucuuggacag

SEQ ID NO: 981 - DNA, 21 bp, Artificial
  Synthethic
gaacggcuacgaaaauccaau

SEQ ID NO: 982 - DNA, 23 bp, Artificial
  Synthethic
auuggatuuucguagccguucug

SEQ ID NO: 983 - DNA, 21 bp, Artificial
  Synthethic
aacggcuacgaaaauccaacu

SEQ ID NO: 984 - DNA, 23 bp, Artificial
  Synthethic
aguuggauuuucguagccguucu

SEQ ID NO: 985 - DNA, 21 bp, Artificial
  Synthethic
acggcuacgaaaauccaaccu

SEQ ID NO: 986 - DNA, 23 bp, Artificial
  Synthethic
agguuggauuuucguagccguuc

SEQ ID NO: 987 - DNA, 21 bp, Artificial
  Synthethic
ggcuacgaaaauccaaccuau

SEQ ID NO: 988 - DNA, 23 bp, Artificial
  Synthethic
auaggutggauuuucguagccgu

SEQ ID NO: 989 - DNA, 21 bp, Artificial
  Synthethic
gcuacgaaaauccaaccuaca

SEQ ID NO: 990 - DNA, 23 bp, Artificial
  Synthethic
uguaggtuggauuuucguagccg

SEQ ID NO: 991 - DNA, 21 bp, Artificial
  Synthethic
cuacgaaaauccaaccuacaa

SEQ ID NO: 992 - DNA, 23 bp, Artificial
  Synthethic
uuguagguuggauuuucguagcc

SEQ ID NO: 993 - DNA, 21 bp, Artificial
  Synthethic
uacgaaaauccaaccuacaau

SEQ ID NO: 994 - DNA, 23 bp, Artificial
  Synthethic
auuguagguuggauuuucguagc

SEQ ID NO: 995 - DNA, 21 bp, Artificial
  Synthethic
acgaaaauccaaccuacaagu

SEQ ID NO: 996 - DNA, 23 bp, Artificial
  Synthethic
acuuguagguuggauuuucguag

SEQ ID NO: 997 - DNA, 21 bp, Artificial
  Synthethic
aaaauccaaccuacaaguucu

SEQ ID NO: 998 - DNA, 23 bp, Artificial
  Synthethic
agaacutguagguuggauuuucg

SEQ ID NO: 999 - DNA, 21 bp, Artificial
  Synthethic
aaauccaaccuacaaguucuu

SEQ ID NO: 1000 - DNA, 23 bp, Artificial
  Synthethic
aagaactuguagguuggauuuuc

SEQ ID NO: 1001 - DNA, 21 bp, Artificial
  Synthethic
auccaaccuacaaguucuuug

SEQ ID NO: 1002 - DNA, 23 bp, Artificial
  Synthethic
caaagaacuuguagguuggauuu

SEQ ID NO: 1003 - DNA, 21 bp, Artificial
  Synthethic
uccaaccuacaaguucuuuga

SEQ ID NO: 1004 - DNA, 23 bp, Artificial
  Synthethic
ucaaagaacuuguagguuggauu

SEQ ID NO: 1005 - DNA, 21 bp, Artificial
  Synthethic
ccaaccuacaaguucuuugau

SEQ ID NO: 1006 - DNA, 23 bp, Artificial
  Synthethic
aucaaagaacuuguagguuggau

SEQ ID NO: 1007 - DNA, 21 bp, Artificial
  Synthethic
ccucugaaguuggacagcaaa

SEQ ID NO: 1008 - DNA, 23 bp, Artificial
  Synthethic
uuugcuguccaacuucagaggcu

SEQ ID NO: 1009 - DNA, 21 bp, Artificial
  Synthethic
aaguuggacagcaaaaccauu

SEQ ID NO: 1010 - DNA, 23 bp, Artificial
  Synthethic
aauggutuugcuguccaacuuca

SEQ ID NO: 1011 - DNA, 21 bp, Artificial
  Synthethic
aguuggacagcaaaaccauuu

SEQ ID NO: 1012 - DNA, 23 bp, Artificial
  Synthethic
aaauggtuuugcuguccaacuuc

SEQ ID NO: 1013 - DNA, 21 bp, Artificial
  Synthethic
uuggacagcaaaaccauugcu

SEQ ID NO: 1014 - DNA, 23 bp, Artificial
  Synthethic
agcaaugguuuugcuguccaacu

SEQ ID NO: 1015 - DNA, 21 bp, Artificial
  Synthethic
gcaaaaccauugcuucacuau

SEQ ID NO: 1016 - DNA, 23 bp, Artificial
  Synthethic
auagugaagcaaugguuuugcug

SEQ ID NO: 1017 - DNA, 21 bp, Artificial
  Synthethic
aaaccauugcuucacuaccca

SEQ ID NO: 1018 - DNA, 23 bp, Artificial
  Synthethic
uggguagugaagcaaugguuuug

SEQ ID NO: 1019 - DNA, 21 bp, Artificial
  Synthethic
uacccaucgguguccauuuau

SEQ ID NO: 1020 - DNA, 23 bp, Artificial
  Synthethic
auaaauggacaccgauggguagu

SEQ ID NO: 1021 - DNA, 21 bp, Artificial
  Synthethic
acccaucgguguccauuuaua

SEQ ID NO: 1022 - DNA, 23 bp, Artificial
  Synthethic
uauaaatggacaccgauggguag

SEQ ID NO: 1023 - DNA, 21 bp, Artificial
  Synthethic
cccaucgguguccauuuauau

SEQ ID NO: 1024 - DNA, 23 bp, Artificial
  Synthethic
auauaaauggacaccgaugggua

SEQ ID NO: 1025 - DNA, 21 bp, Artificial
  Synthethic
ccaucgguguccauuuauaga

SEQ ID NO: 1026 - DNA, 23 bp, Artificial
  Synthethic
ucuauaaauggacaccgaugggu

SEQ ID NO: 1027 - DNA, 21 bp, Artificial
  Synthethic
aucgguguccauuuauagaau

SEQ ID NO: 1028 - DNA, 23 bp, Artificial
  Synthethic
auucuataaauggacaccgaugg

SEQ ID NO: 1029 - DNA, 21 bp, Artificial
  Synthethic
ucgguguccauuuauagaaua

SEQ ID NO: 1030 - DNA, 23 bp, Artificial
  Synthethic
uauucuauaaauggacaccgaug

SEQ ID NO: 1031 - DNA, 21 bp, Artificial
  Synthethic
acccguuuuaugauuuacuca

SEQ ID NO: 1032 - DNA, 23 bp, Artificial
  Synthethic
ugaguaaaucauaaaacggguuu

SEQ ID NO: 1033 - DNA, 21 bp, Artificial
  Synthethic
cccguuuuaugauuuacucau

SEQ ID NO: 1034 - DNA, 23 bp, Artificial
  Synthethic
augaguaaaucauaaaacggguu

SEQ ID NO: 1035 - DNA, 21 bp, Artificial
  Synthethic
uuaugauuuacucauuaucgu

SEQ ID NO: 1036 - DNA, 23 bp, Artificial
  Synthethic
acgauaaugaguaaaucauaaaa

SEQ ID NO: 1037 - DNA, 21 bp, Artificial
  Synthethic
augauuuacucauuaucgccu

SEQ ID NO: 1038 - DNA, 23 bp, Artificial
  Synthethic
aggcgataaugaguaaaucauaa

SEQ ID NO: 1039 - DNA, 21 bp, Artificial
  Synthethic
ugauuuacucauuaucgccuu

SEQ ID NO: 1040 - DNA, 23 bp, Artificial
  Synthethic
aaggcgauaaugaguaaaucaua

SEQ ID NO: 1041 - DNA, 21 bp, Artificial
  Synthethic
gauuuacucauuaucgccuuu

SEQ ID NO: 1042 - DNA, 23 bp, Artificial
  Synthethic
aaaggcgauaaugaguaaaucau

SEQ ID NO: 1043 - DNA, 21 bp, Artificial
  Synthethic
auuuacucauuaucgccuuuu

SEQ ID NO: 1044 - DNA, 23 bp, Artificial
  Synthethic
aaaaggcgauaaugaguaaauca

SEQ ID NO: 1045 - DNA, 21 bp, Artificial
  Synthethic
uuuacucauuaucgccuuuug

SEQ ID NO: 1046 - DNA, 23 bp, Artificial
  Synthethic
caaaaggcgauaaugaguaaauc

SEQ ID NO: 1047 - DNA, 21 bp, Artificial
  Synthethic
uacucauuaucgccuuuugau

SEQ ID NO: 1048 - DNA, 23 bp, Artificial
  Synthethic
aucaaaaggcgauaaugaguaaa

SEQ ID NO: 1049 - DNA, 21 bp, Artificial
  Synthethic
acucauuaucgccuuuugaca

SEQ ID NO: 1050 - DNA, 23 bp, Artificial
  Synthethic
ugucaaaaggcgauaaugaguaa

SEQ ID NO: 1051 - DNA, 21 bp, Artificial
  Synthethic
cucauuaucgccuuuugacau

SEQ ID NO: 1052 - DNA, 23 bp, Artificial
  Synthethic
augucaaaaggcgauaaugagua

SEQ ID NO: 1053 - DNA, 21 bp, Artificial
  Synthethic
uuaucgccuuuugacagcugu

SEQ ID NO: 1054 - DNA, 23 bp, Artificial
  Synthethic
acagcugucaaaaggcgauaaug

SEQ ID NO: 1055 - DNA, 21 bp, Artificial
  Synthethic
aucgccuuuugacagcugugu

SEQ ID NO: 1056 - DNA, 23 bp, Artificial
  Synthethic
acacagcugucaaaaggcgauaa

SEQ ID NO: 1057 - DNA, 21 bp, Artificial
  Synthethic
uuuugacagcugugcuguaau

SEQ ID NO: 1058 - DNA, 23 bp, Artificial
  Synthethic
auuacagcacagcugucaaaagg

SEQ ID NO: 1059 - DNA, 21 bp, Artificial
  Synthethic
uugacagcugugcuguaacau

SEQ ID NO: 1060 - DNA, 23 bp, Artificial
  Synthethic
auguuacagcacagcugucaaaa

SEQ ID NO: 1061 - DNA, 21 bp, Artificial
  Synthethic
acagcugugcuguaacacaau

SEQ ID NO: 1062 - DNA, 23 bp, Artificial
  Synthethic
auugugtuacagcacagcuguca

SEQ ID NO: 1063 - DNA, 21 bp, Artificial
  Synthethic
agcugugcuguaacacaagua

SEQ ID NO: 1064 - DNA, 23 bp, Artificial
  Synthethic
uacuugtguuacagcacagcugu

SEQ ID NO: 1065 - DNA, 21 bp, Artificial
  Synthethic
ugugcuguaacacaaguagau

SEQ ID NO: 1066 - DNA, 23 bp, Artificial
  Synthethic
aucuactuguguuacagcacagc

SEQ ID NO: 1067 - DNA, 21 bp, Artificial
  Synthethic
gugcuguaacacaaguagauu

SEQ ID NO: 1068 - DNA, 23 bp, Artificial
  Synthethic
aaucuacuuguguuacagcacag

SEQ ID NO: 1069 - DNA, 21 bp, Artificial
  Synthethic
gcuguaacacaaguagaugcu

SEQ ID NO: 1070 - DNA, 23 bp, Artificial
  Synthethic
agcauctacuuguguuacagcac

SEQ ID NO: 1071 - DNA, 21 bp, Artificial
  Synthethic
acacaaguagaugccugaacu

SEQ ID NO: 1072 - DNA, 23 bp, Artificial
  Synthethic
aguucaggcaucuacuuguguua

SEQ ID NO: 1073 - DNA, 21 bp, Artificial
  Synthethic
aaguagaugccugaacuugaa

SEQ ID NO: 1074 - DNA, 23 bp, Artificial
  Synthethic
uucaagtucaggcaucuacuugu

SEQ ID NO: 1075 - DNA, 21 bp, Artificial
  Synthethic
guagaugccugaacuugaauu

SEQ ID NO: 1076 - DNA, 23 bp, Artificial
  Synthethic
aauucaaguucaggcaucuacuu

SEQ ID NO: 1077 - DNA, 21 bp, Artificial
  Synthethic
ugccugaacuugaauuaaucu

SEQ ID NO: 1078 - DNA, 23 bp, Artificial
  Synthethic
agauuaauucaaguucaggcauc

SEQ ID NO: 1079 - DNA, 21 bp, Artificial
  Synthethic
ccugaacuugaauuaauccau

SEQ ID NO: 1080 - DNA, 23 bp, Artificial
  Synthethic
auggautaauucaaguucaggca

SEQ ID NO: 1081 - DNA, 21 bp, Artificial
  Synthethic
cugaacuugaauuaauccaca

SEQ ID NO: 1082 - DNA, 23 bp, Artificial
  Synthethic
uguggatuaauucaaguucaggc

SEQ ID NO: 1083 - DNA, 21 bp, Artificial
  Synthethic
auccacacaucaguaauguau

SEQ ID NO: 1084 - DNA, 23 bp, Artificial
  Synthethic
auacautacugauguguggauua

SEQ ID NO: 1085 - DNA, 21 bp, Artificial
  Synthethic
uccacacaucaguaauguauu

SEQ ID NO: 1086 - DNA, 23 bp, Artificial
  Synthethic
aauacatuacugauguguggauu

SEQ ID NO: 1087 - DNA, 21 bp, Artificial
  Synthethic
ccacacaucaguaauguauuu

SEQ ID NO: 1088 - DNA, 23 bp, Artificial
  Synthethic
aaauacauuacugauguguggau

SEQ ID NO: 1089 - DNA, 21 bp, Artificial
  Synthethic
cacacaucaguaauguauucu

SEQ ID NO: 1090 - DNA, 23 bp, Artificial
  Synthethic
agaauacauuacugaugugugga

SEQ ID NO: 1091 - DNA, 21 bp, Artificial
  Synthethic
acacaucaguaauguauucua

SEQ ID NO: 1092 - DNA, 23 bp, Artificial
  Synthethic
uagaauacauuacugaugugugg

SEQ ID NO: 1093 - DNA, 21 bp, Artificial
  Synthethic
uguauucuaucucucuuuaca

SEQ ID NO: 1094 - DNA, 23 bp, Artificial
  Synthethic
uguaaagagagauagaauacauu

SEQ ID NO: 1095 - DNA, 21 bp, Artificial
  Synthethic
cuaucucucuuuacauuuugu

SEQ ID NO: 1096 - DNA, 23 bp, Artificial
  Synthethic
acaaaatguaaagagagauagaa

SEQ ID NO: 1097 - DNA, 21 bp, Artificial
  Synthethic
uaucucucuuuacauuuuggu

SEQ ID NO: 1098 - DNA, 23 bp, Artificial
  Synthethic
accaaaauguaaagagagauaga

SEQ ID NO: 1099 - DNA, 21 bp, Artificial
  Synthethic
aucucucuuuacauuuugguu

SEQ ID NO: 1100 - DNA, 23 bp, Artificial
  Synthethic
aaccaaaauguaaagagagauag

SEQ ID NO: 1101 - DNA, 21 bp, Artificial
  Synthethic
ucucucuuuacauuuuggucu

SEQ ID NO: 1102 - DNA, 23 bp, Artificial
  Synthethic
agaccaaaauguaaagagagaua

SEQ ID NO: 1103 - DNA, 21 bp, Artificial
  Synthethic
cucucuuuacauuuuggucuu

SEQ ID NO: 1104 - DNA, 23 bp, Artificial
  Synthethic
aagaccaaaauguaaagagagau

SEQ ID NO: 1105 - DNA, 21 bp, Artificial
  Synthethic
ucuuuacauuuuggucucuau

SEQ ID NO: 1106 - DNA, 23 bp, Artificial
  Synthethic
auagagaccaaaauguaaagaga

SEQ ID NO: 1107 - DNA, 21 bp, Artificial
  Synthethic
uggucucuauacuacauuauu

SEQ ID NO: 1108 - DNA, 23 bp, Artificial
  Synthethic
aauaauguaguauagagaccaaa

SEQ ID NO: 1109 - DNA, 21 bp, Artificial
  Synthethic
ggucucuauacuacauuauua

SEQ ID NO: 1110 - DNA, 23 bp, Artificial
  Synthethic
uaauaatguaguauagagaccaa

SEQ ID NO: 1111 - DNA, 21 bp, Artificial
  Synthethic
gucucuauacuacauuauuaa

SEQ ID NO: 1112 - DNA, 23 bp, Artificial
  Synthethic
uuaauaauguaguauagagacca

SEQ ID NO: 1113 - DNA, 21 bp, Artificial
  Synthethic
ucucuauacuacauuauuaau

SEQ ID NO: 1114 - DNA, 23 bp, Artificial
  Synthethic
auuaauaauguaguauagagacc

SEQ ID NO: 1115 - DNA, 21 bp, Artificial
  Synthethic
cucuauacuacauuauuaauu

SEQ ID NO: 1116 - DNA, 23 bp, Artificial
  Synthethic
aauuaataauguaguauagagac

SEQ ID NO: 1117 - DNA, 21 bp, Artificial
  Synthethic
ucuauacuacauuauuaaugu

SEQ ID NO: 1118 - DNA, 23 bp, Artificial
  Synthethic
acauuaauaauguaguauagaga

SEQ ID NO: 1119 - DNA, 21 bp, Artificial
  Synthethic
cuauacuacauuauuaauggu

SEQ ID NO: 1120 - DNA, 23 bp, Artificial
  Synthethic
accauuaauaauguaguauagag

SEQ ID NO: 1121 - DNA, 21 bp, Artificial
  Synthethic
auggguuuuguguacuguaaa

SEQ ID NO: 1122 - DNA, 23 bp, Artificial
  Synthethic
uuuacaguacacaaaacccauua

SEQ ID NO: 1123 - DNA, 21 bp, Artificial
  Synthethic
uuuguguacuguaaagaauuu

SEQ ID NO: 1124 - DNA, 23 bp, Artificial
  Synthethic
aaauuctuuacaguacacaaaac

SEQ ID NO: 1125 - DNA, 21 bp, Artificial
  Synthethic
uuguguacuguaaagaauuua

SEQ ID NO: 1126 - DNA, 23 bp, Artificial
  Synthethic
uaaauucuuuacaguacacaaaa

SEQ ID NO: 1127 - DNA, 21 bp, Artificial
  Synthethic
uguguacuguaaagaauuuau

SEQ ID NO: 1128 - DNA, 23 bp, Artificial
  Synthethic
auaaautcuuuacaguacacaaa

SEQ ID NO: 1129 - DNA, 21 bp, Artificial
  Synthethic
guguacuguaaagaauuuagu

SEQ ID NO: 1130 - DNA, 23 bp, Artificial
  Synthethic
acuaaatucuuuacaguacacaa

SEQ ID NO: 1131 - DNA, 21 bp, Artificial
  Synthethic
guacuguaaagaauuuagcuu

SEQ ID NO: 1132 - DNA, 23 bp, Artificial
  Synthethic
aagcuaaauucuuuacaguacac

SEQ ID NO: 1133 - DNA, 21 bp, Artificial
  Synthethic
auuuagcuguaucaaacuagu

SEQ ID NO: 1134 - DNA, 23 bp, Artificial
  Synthethic
acuagutugauacagcuaaauuc

SEQ ID NO: 1135 - DNA, 21 bp, Artificial
  Synthethic
uuuagcuguaucaaacuaguu

SEQ ID NO: 1136 - DNA, 23 bp, Artificial
  Synthethic
aacuagtuugauacagcuaaauu

SEQ ID NO: 1137 - DNA, 21 bp, Artificial
  Synthethic
gcuguaucaaacuagugcauu

SEQ ID NO: 1138 - DNA, 23 bp, Artificial
  Synthethic
aaugcacuaguuugauacagcua

SEQ ID NO: 1139 - DNA, 21 bp, Artificial
  Synthethic
cuagugcaugaauagauucuu

SEQ ID NO: 1140 - DNA, 23 bp, Artificial
  Synthethic
aagaaucuauucaugcacuaguu

SEQ ID NO: 1141 - DNA, 21 bp, Artificial
  Synthethic
uagugcaugaauagauucucu

SEQ ID NO: 1142 - DNA, 23 bp, Artificial
  Synthethic
agagaatcuauucaugcacuagu

SEQ ID NO: 1143 - DNA, 21 bp, Artificial
  Synthethic
gaauagauucucuccugauua

SEQ ID NO: 1144 - DNA, 23 bp, Artificial
  Synthethic
uaaucaggagagaaucuauucau

SEQ ID NO: 1145 - DNA, 21 bp, Artificial
  Synthethic
cucuccugauuauuuaucaca

SEQ ID NO: 1146 - DNA, 23 bp, Artificial
  Synthethic
ugugauaaauaaucaggagagaa

SEQ ID NO: 1147 - DNA, 21 bp, Artificial
  Synthethic
ucuccugauuauuuaucacau

SEQ ID NO: 1148 - DNA, 23 bp, Artificial
  Synthethic
augugataaauaaucaggagaga

SEQ ID NO: 1149 - DNA, 21 bp, Artificial
  Synthethic
cuccugauuauuuaucacaua

SEQ ID NO: 1150 - DNA, 23 bp, Artificial
  Synthethic
uaugugauaaauaaucaggagag

SEQ ID NO: 1151 - DNA, 21 bp, Artificial
  Synthethic
uccugauuauuuaucacauau

SEQ ID NO: 1152 - DNA, 23 bp, Artificial
  Synthethic
auaugugauaaauaaucaggaga

SEQ ID NO: 1153 - DNA, 21 bp, Artificial
  Synthethic
ccugauuauuuaucacauagu

SEQ ID NO: 1154 - DNA, 23 bp, Artificial
  Synthethic
acuaugtgauaaauaaucaggag

SEQ ID NO: 1155 - DNA, 21 bp, Artificial
  Synthethic
gccaguuguauauuauucuuu

SEQ ID NO: 1156 - DNA, 23 bp, Artificial
  Synthethic
aaagaataauauacaacuggcua

SEQ ID NO: 1157 - DNA, 21 bp, Artificial
  Synthethic
uuguauauuauucuugugguu

SEQ ID NO: 1158 - DNA, 23 bp, Artificial
  Synthethic
aaccacaagaauaauauacaacu

SEQ ID NO: 1159 - DNA, 21 bp, Artificial
  Synthethic
ucuugugguuugugacccaau

SEQ ID NO: 1160 - DNA, 23 bp, Artificial
  Synthethic
auugggtcacaaaccacaagaau

SEQ ID NO: 1161 - DNA, 21 bp, Artificial
  Synthethic
cuugugguuugugacccaauu

SEQ ID NO: 1162 - DNA, 23 bp, Artificial
  Synthethic
aauugggucacaaaccacaagaa

SEQ ID NO: 1163 - DNA, 21 bp, Artificial
  Synthethic
uugugguuugugacccaauua

SEQ ID NO: 1164 - DNA, 23 bp, Artificial
  Synthethic
uaauugggucacaaaccacaaga

SEQ ID NO: 1165 - DNA, 21 bp, Artificial
  Synthethic
ugugguuugugacccaauuaa

SEQ ID NO: 1166 - DNA, 23 bp, Artificial
  Synthethic
uuaauugggucacaaaccacaag

SEQ ID NO: 1167 - DNA, 21 bp, Artificial
  Synthethic
guuugugacccaauuaagucu

SEQ ID NO: 1168 - DNA, 23 bp, Artificial
  Synthethic
agacuuaauugggucacaaacca

SEQ ID NO: 1169 - DNA, 21 bp, Artificial
  Synthethic
uuugugacccaauuaaguccu

SEQ ID NO: 1170 - DNA, 23 bp, Artificial
  Synthethic
aggacutaauugggucacaaacc

SEQ ID NO: 1171 - DNA, 21 bp, Artificial
  Synthethic
uugugacccaauuaaguccua

SEQ ID NO: 1172 - DNA, 23 bp, Artificial
  Synthethic
uaggactuaauugggucacaaac

SEQ ID NO: 1173 - DNA, 21 bp, Artificial
  Synthethic
ugugacccaauuaaguccuau

SEQ ID NO: 1174 - DNA, 23 bp, Artificial
  Synthethic
auaggacuuaauugggucacaaa

SEQ ID NO: 1175 - DNA, 21 bp, Artificial
  Synthethic
gugacccaauuaaguccuacu

SEQ ID NO: 1176 - DNA, 23 bp, Artificial
  Synthethic
aguaggacuuaauugggucacaa

SEQ ID NO: 1177 - DNA, 21 bp, Artificial
  Synthethic
gacccaauuaaguccuacuuu

SEQ ID NO: 1178 - DNA, 23 bp, Artificial
  Synthethic
aaaguaggacuuaauugggucac

SEQ ID NO: 1179 - DNA, 21 bp, Artificial
  Synthethic
acccaauuaaguccuacuuua

SEQ ID NO: 1180 - DNA, 23 bp, Artificial
  Synthethic
uaaaguaggacuuaauuggguca

SEQ ID NO: 1181 - DNA, 21 bp, Artificial
  Synthethic
cccaauuaaguccuacuuuau

SEQ ID NO: 1182 - DNA, 23 bp, Artificial
  Synthethic
auaaagtaggacuuaauuggguc

SEQ ID NO: 1183 - DNA, 21 bp, Artificial
  Synthethic
aauuaaguccuacuuuacaua

SEQ ID NO: 1184 - DNA, 23 bp, Artificial
  Synthethic
uauguaaaguaggacuuaauugg

SEQ ID NO: 1185 - DNA, 21 bp, Artificial
  Synthethic
uaaguccuacuuuacauaugu

SEQ ID NO: 1186 - DNA, 23 bp, Artificial
  Synthethic
acauauguaaaguaggacuuaau

SEQ ID NO: 1187 - DNA, 21 bp, Artificial
  Synthethic
aguccuacuuuacauaugcuu

SEQ ID NO: 1188 - DNA, 23 bp, Artificial
  Synthethic
aagcauauguaaaguaggacuua

SEQ ID NO: 1189 - DNA, 21 bp, Artificial
  Synthethic
guccuacuuuacauaugcuuu

SEQ ID NO: 1190 - DNA, 23 bp, Artificial
  Synthethic
aaagcatauguaaaguaggacuu

SEQ ID NO: 1191 - DNA, 21 bp, Artificial
  Synthethic
uccuacuuuacauaugcuuua

SEQ ID NO: 1192 - DNA, 23 bp, Artificial
  Synthethic
uaaagcauauguaaaguaggacu

SEQ ID NO: 1193 - DNA, 21 bp, Artificial
  Synthethic
ccuacuuuacauaugcuuuaa

SEQ ID NO: 1194 - DNA, 23 bp, Artificial
  Synthethic
uuaaagcauauguaaaguaggac

SEQ ID NO: 1195 - DNA, 21 bp, Artificial
  Synthethic
cuacuuuacauaugcuuuaau

SEQ ID NO: 1196 - DNA, 23 bp, Artificial
  Synthethic
auuaaagcauauguaaaguagga

SEQ ID NO: 1197 - DNA, 21 bp, Artificial
  Synthethic
uacauaugcuuuaagaaucga

SEQ ID NO: 1198 - DNA, 23 bp, Artificial
  Synthethic
ucgauucuuaaagcauauguaaa

SEQ ID NO: 1199 - DNA, 21 bp, Artificial
  Synthethic
cauaugcuuuaagaaucgauu

SEQ ID NO: 1200 - DNA, 23 bp, Artificial
  Synthethic
aaucgatucuuaaagcauaugua

SEQ ID NO: 1201 - DNA, 21 bp, Artificial
  Synthethic
auaugcuuuaagaaucgaugu

SEQ ID NO: 1202 - DNA, 23 bp, Artificial
  Synthethic
acaucgauucuuaaagcauaugu

SEQ ID NO: 1203 - DNA, 21 bp, Artificial
  Synthethic
uaugcuuuaagaaucgauggu

SEQ ID NO: 1204 - DNA, 23 bp, Artificial
  Synthethic
accaucgauucuuaaagcauaug

SEQ ID NO: 1205 - DNA, 21 bp, Artificial
  Synthethic
gggaugcuucaugugaacguu

SEQ ID NO: 1206 - DNA, 23 bp, Artificial
  Synthethic
aacguucacaugaagcauccccc

SEQ ID NO: 1207 - DNA, 21 bp, Artificial
  Synthethic
ugcuucucuugccuaaguauu

SEQ ID NO: 1208 - DNA, 23 bp, Artificial
  Synthethic
aauacutaggcaagagaagcagc

SEQ ID NO: 1209 - DNA, 21 bp, Artificial
  Synthethic
cuucucuugccuaaguauucu

SEQ ID NO: 1210 - DNA, 23 bp, Artificial
  Synthethic
agaauacuuaggcaagagaagca

SEQ ID NO: 1211 - DNA, 21 bp, Artificial
  Synthethic
uucucuugccuaaguauuccu

SEQ ID NO: 1212 - DNA, 23 bp, Artificial
  Synthethic
aggaauacuuaggcaagagaagc

SEQ ID NO: 1213 - DNA, 21 bp, Artificial
  Synthethic
cucuugccuaaguauuccuuu

SEQ ID NO: 1214 - DNA, 23 bp, Artificial
  Synthethic
aaaggaauacuuaggcaagagaa

SEQ ID NO: 1215 - DNA, 21 bp, Artificial
  Synthethic
cuugccuaaguauuccuuucu

SEQ ID NO: 1216 - DNA, 23 bp, Artificial
  Synthethic
agaaaggaauacuuaggcaagag

SEQ ID NO: 1217 - DNA, 21 bp, Artificial
  Synthethic
ugccuaaguauuccuuuccuu

SEQ ID NO: 1218 - DNA, 23 bp, Artificial
  Synthethic
aaggaaaggaauacuuaggcaag

SEQ ID NO: 1219 - DNA, 21 bp, Artificial
  Synthethic
aaguauuccuuuccugaucau

SEQ ID NO: 1220 - DNA, 23 bp, Artificial
  Synthethic
augaucaggaaaggaauacuuag

SEQ ID NO: 1221 - DNA, 21 bp, Artificial
  Synthethic
aguauuccuuuccugaucacu

SEQ ID NO: 1222 - DNA, 23 bp, Artificial
  Synthethic
agugaucaggaaaggaauacuua

SEQ ID NO: 1223 - DNA, 21 bp, Artificial
  Synthethic
guauuccuuuccugaucacua

SEQ ID NO: 1224 - DNA, 23 bp, Artificial
  Synthethic
uagugatcaggaaaggaauacuu

SEQ ID NO: 1225 - DNA, 21 bp, Artificial
  Synthethic
uauuccuuuccugaucacuau

SEQ ID NO: 1226 - DNA, 23 bp, Artificial
  Synthethic
auagugaucaggaaaggaauacu

SEQ ID NO: 1227 - DNA, 21 bp, Artificial
  Synthethic
auuccuuuccugaucacuauu

SEQ ID NO: 1228 - DNA, 23 bp, Artificial
  Synthethic
aauagugaucaggaaaggaauac

SEQ ID NO: 1229 - DNA, 21 bp, Artificial
  Synthethic
uccuuuccugaucacuaugca

SEQ ID NO: 1230 - DNA, 23 bp, Artificial
  Synthethic
ugcauagugaucaggaaaggaau

SEQ ID NO: 1231 - DNA, 21 bp, Artificial
  Synthethic
cuuuccugaucacuaugcauu

SEQ ID NO: 1232 - DNA, 23 bp, Artificial
  Synthethic
aaugcatagugaucaggaaagga

SEQ ID NO: 1233 - DNA, 21 bp, Artificial
  Synthethic
uuuccugaucacuaugcauuu

SEQ ID NO: 1234 - DNA, 23 bp, Artificial
  Synthethic
aaaugcauagugaucaggaaagg

SEQ ID NO: 1235 - DNA, 21 bp, Artificial
  Synthethic
uuccugaucacuaugcauuuu

SEQ ID NO: 1236 - DNA, 23 bp, Artificial
  Synthethic
aaaaugcauagugaucaggaaag

SEQ ID NO: 1237 - DNA, 21 bp, Artificial
  Synthethic
cugaucacuaugcauuuuaaa

SEQ ID NO: 1238 - DNA, 23 bp, Artificial
  Synthethic
uuuaaaaugcauagugaucagga

SEQ ID NO: 1239 - DNA, 21 bp, Artificial
  Synthethic
cacuaugcauuuuaaaguuaa

SEQ ID NO: 1240 - DNA, 23 bp, Artificial
  Synthethic
uuaacutuaaaaugcauagugau

SEQ ID NO: 1241 - DNA, 21 bp, Artificial
  Synthethic
acuaugcauuuuaaaguuaaa

SEQ ID NO: 1242 - DNA, 23 bp, Artificial
  Synthethic
uuuaactuuaaaaugcauaguga

SEQ ID NO: 1243 - DNA, 21 bp, Artificial
  Synthethic
uuccaugacugcauuuuacuu

SEQ ID NO: 1244 - DNA, 23 bp, Artificial
  Synthethic
aaguaaaaugcagucauggaaaa

SEQ ID NO: 1245 - DNA, 21 bp, Artificial
  Synthethic
cugcauuuuacuguacagauu

SEQ ID NO: 1246 - DNA, 23 bp, Artificial
  Synthethic
aaucugtacaguaaaaugcaguc

SEQ ID NO: 1247 - DNA, 21 bp, Artificial
  Synthethic
auugcugcuucugcuauauuu

SEQ ID NO: 1248 - DNA, 23 bp, Artificial
  Synthethic
aaauauagcagaagcagcaaucu

SEQ ID NO: 1249 - DNA, 21 bp, Artificial
  Synthethic
uucugcuauauuugugauaua

SEQ ID NO: 1250 - DNA, 23 bp, Artificial
  Synthethic
uauaucacaaauauagcagaagc

SEQ ID NO: 1251 - DNA, 21 bp, Artificial
  Synthethic
ucugcuauauuugugauauau

SEQ ID NO: 1252 - DNA, 23 bp, Artificial
  Synthethic
auauaucacaaauauagcagaag

SEQ ID NO: 1253 - DNA, 21 bp, Artificial
  Synthethic
ugcuauauuugugauauagga

SEQ ID NO: 1254 - DNA, 23 bp, Artificial
  Synthethic
uccuauaucacaaauauagcaga

SEQ ID NO: 1255 - DNA, 21 bp, Artificial
  Synthethic
uuugugauauaggaauuaaga

SEQ ID NO: 1256 - DNA, 23 bp, Artificial
  Synthethic
ucuuaatuccuauaucacaaaua

SEQ ID NO: 1257 - DNA, 21 bp, Artificial
  Synthethic
ucuucgugccuguuuuauguu

SEQ ID NO: 1258 - DNA, 23 bp, Artificial
  Synthethic
aacauaaaacaggcacgaagaaa

SEQ ID NO: 1259 - DNA, 21 bp, Artificial
  Synthethic
cuucgugccuguuuuaugugu

SEQ ID NO: 1260 - DNA, 23 bp, Artificial
  Synthethic
acacauaaaacaggcacgaagaa

SEQ ID NO: 1261 - DNA, 21 bp, Artificial
  Synthethic
guuuuaugugcacacauuagu

SEQ ID NO: 1262 - DNA, 23 bp, Artificial
  Synthethic
acuaaugugugcacauaaaacag

SEQ ID NO: 1263 - DNA, 21 bp, Artificial
  Synthethic
ugugcacacauuaggcauuga

SEQ ID NO: 1264 - DNA, 23 bp, Artificial
  Synthethic
ucaaugccuaaugugugcacaua

SEQ ID NO: 1265 - DNA, 21 bp, Artificial
  Synthethic
ugcacacauuaggcauugaga

SEQ ID NO: 1266 - DNA, 23 bp, Artificial
  Synthethic
ucucaatgccuaaugugugcaca

SEQ ID NO: 1267 - DNA, 21 bp, Artificial
  Synthethic
acacauuaggcauugagacuu

SEQ ID NO: 1268 - DNA, 23 bp, Artificial
  Synthethic
aagucucaaugccuaaugugugc

SEQ ID NO: 1269 - DNA, 21 bp, Artificial
  Synthethic
uuuguccacguaucuuugggu

SEQ ID NO: 1270 - DNA, 23 bp, Artificial
  Synthethic
acccaaagauacguggacaaaaa

SEQ ID NO: 1271 - DNA, 21 bp, Artificial
  Synthethic
cacguaucuuugggucuuuga

SEQ ID NO: 1272 - DNA, 23 bp, Artificial
  Synthethic
ucaaagacccaaagauacgugga

SEQ ID NO: 1273 - DNA, 21 bp, Artificial
  Synthethic
acguaucuuugggucuuugau

SEQ ID NO: 1274 - DNA, 23 bp, Artificial
  Synthethic
aucaaagacccaaagauacgugg

SEQ ID NO: 1275 - DNA, 21 bp, Artificial
  Synthethic
ucuuugggucuuugauaaaga

SEQ ID NO: 1276 - DNA, 23 bp, Artificial
  Synthethic
ucuuuatcaaagacccaaagaua

SEQ ID NO: 1277 - DNA, 21 bp, Artificial
  Synthethic
cuuugggucuuugauaaagaa

SEQ ID NO: 1278 - DNA, 23 bp, Artificial
  Synthethic
uucuuuaucaaagacccaaagau

SEQ ID NO: 1279 - DNA, 21 bp, Artificial
  Synthethic
uugggucuuugauaaagaaaa

SEQ ID NO: 1280 - DNA, 23 bp, Artificial
  Synthethic
uuuucutuaucaaagacccaaag

SEQ ID NO: 1281 - DNA, 21 bp, Artificial
  Synthethic
ugggucuuugauaaagaaaau

SEQ ID NO: 1282 - DNA, 23 bp, Artificial
  Synthethic
auuuuctuuaucaaagacccaaa

SEQ ID NO: 1283 - DNA, 21 bp, Artificial
  Synthethic
aaagaaucccuguucauugua

SEQ ID NO: 1284 - DNA, 23 bp, Artificial
  Synthethic
uacaaugaacagggauucuuuuc

SEQ ID NO: 1285 - DNA, 21 bp, Artificial
  Synthethic
aagaaucccuguucauuguaa

SEQ ID NO: 1286 - DNA, 23 bp, Artificial
  Synthethic
uuacaatgaacagggauucuuuu

SEQ ID NO: 1287 - DNA, 21 bp, Artificial
  Synthethic
agaaucccuguucauuguaau

SEQ ID NO: 1288 - DNA, 23 bp, Artificial
  Synthethic
auuacaaugaacagggauucuuu

SEQ ID NO: 1289 - DNA, 21 bp, Artificial
  Synthethic
gaaucccuguucauuguaagu

SEQ ID NO: 1290 - DNA, 23 bp, Artificial
  Synthethic
acuuacaaugaacagggauucuu

SEQ ID NO: 1291 - DNA, 21 bp, Artificial
  Synthethic
uguucauuguaagcacuuuua

SEQ ID NO: 1292 - DNA, 23 bp, Artificial
  Synthethic
uaaaagtgcuuacaaugaacagg

SEQ ID NO: 1293 - DNA, 21 bp, Artificial
  Synthethic
guucauuguaagcacuuuuau

SEQ ID NO: 1294 - DNA, 23 bp, Artificial
  Synthethic
auaaaagugcuuacaaugaacag

SEQ ID NO: 1295 - DNA, 21 bp, Artificial
  Synthethic
ucauuguaagcacuuuuacgu

SEQ ID NO: 1296 - DNA, 23 bp, Artificial
  Synthethic
acguaaaagugcuuacaaugaac

SEQ ID NO: 1297 - DNA, 21 bp, Artificial
  Synthethic
cauuguaagcacuuuuacggu

SEQ ID NO: 1298 - DNA, 23 bp, Artificial
  Synthethic
accguaaaagugcuuacaaugaa

SEQ ID NO: 1299 - DNA, 21 bp, Artificial
  Synthethic
cuggucuucaauuaccaagaa

SEQ ID NO: 1300 - DNA, 23 bp, Artificial
  Synthethic
uucuugguaauugaagaccagca

SEQ ID NO: 1301 - DNA, 21 bp, Artificial
  Synthethic
ggucuucaauuaccaagaauu

SEQ ID NO: 1302 - DNA, 23 bp, Artificial
  Synthethic
aauucutgguaauugaagaccag

SEQ ID NO: 1303 - DNA, 21 bp, Artificial
  Synthethic
ucuucaauuaccaagaauucu

SEQ ID NO: 1304 - DNA, 23 bp, Artificial
  Synthethic
agaauucuugguaauugaagacc

SEQ ID NO: 1305 - DNA, 21 bp, Artificial
  Synthethic
cuucaauuaccaagaauucuu

SEQ ID NO: 1306 - DNA, 23 bp, Artificial
  Synthethic
aagaautcuugguaauugaagac

SEQ ID NO: 1307 - DNA, 21 bp, Artificial
  Synthethic
uucaauuaccaagaauucucu

SEQ ID NO: 1308 - DNA, 23 bp, Artificial
  Synthethic
agagaatucuugguaauugaaga

SEQ ID NO: 1309 - DNA, 21 bp, Artificial
  Synthethic
ucaauuaccaagaauucucca

SEQ ID NO: 1310 - DNA, 23 bp, Artificial
  Synthethic
uggagaauucuugguaauugaag

SEQ ID NO: 1311 - DNA, 21 bp, Artificial
  Synthethic
aauuaccaagaauucuccaaa

SEQ ID NO: 1312 - DNA, 23 bp, Artificial
  Synthethic
uuuggagaauucuugguaauuga

SEQ ID NO: 1313 - DNA, 21 bp, Artificial
  Synthethic
uuaccaagaauucuccaaaau

SEQ ID NO: 1314 - DNA, 23 bp, Artificial
  Synthethic
auuuuggagaauucuugguaauu

SEQ ID NO: 1315 - DNA, 21 bp, Artificial
  Synthethic
ugauuguacagaaucauugcu

SEQ ID NO: 1316 - DNA, 23 bp, Artificial
  Synthethic
agcaaugauucuguacaaucauc

SEQ ID NO: 1317 - DNA, 21 bp, Artificial
  Synthethic
ucauugcuuaugacaugaucu

SEQ ID NO: 1318 - DNA, 23 bp, Artificial
  Synthethic
agaucatgucauaagcaaugauu

SEQ ID NO: 1319 - DNA, 21 bp, Artificial
  Synthethic
cauugcuuaugacaugaucgu

SEQ ID NO: 1320 - DNA, 23 bp, Artificial
  Synthethic
acgaucaugucauaagcaaugau

SEQ ID NO: 1321 - DNA, 21 bp, Artificial
  Synthethic
auugcuuaugacaugaucgcu

SEQ ID NO: 1322 - DNA, 23 bp, Artificial
  Synthethic
agcgaucaugucauaagcaauga

SEQ ID NO: 1323 - DNA, 21 bp, Artificial
  Synthethic
uugcuuaugacaugaucgcuu

SEQ ID NO: 1324 - DNA, 23 bp, Artificial
  Synthethic
aagcgatcaugucauaagcaaug

SEQ ID NO: 1325 - DNA, 21 bp, Artificial
  Synthethic
ugcuuaugacaugaucgcuuu

SEQ ID NO: 1326 - DNA, 23 bp, Artificial
  Synthethic
aaagcgaucaugucauaagcaau

SEQ ID NO: 1327 - DNA, 21 bp, Artificial
  Synthethic
gcuuaugacaugaucgcuuuc

SEQ ID NO: 1328 - DNA, 23 bp, Artificial
  Synthethic
gaaagcgaucaugucauaagcaa

SEQ ID NO: 1329 - DNA, 21 bp, Artificial
  Synthethic
cuuaugacaugaucgcuuucu

SEQ ID NO: 1330 - DNA, 23 bp, Artificial
  Synthethic
agaaagcgaucaugucauaagca

SEQ ID NO: 1331 - DNA, 21 bp, Artificial
  Synthethic
uuaugacaugaucgcuuucua

SEQ ID NO: 1332 - DNA, 23 bp, Artificial
  Synthethic
uagaaagcgaucaugucauaagc

SEQ ID NO: 1333 - DNA, 21 bp, Artificial
  Synthethic
uaugacaugaucgcuuucuau

SEQ ID NO: 1334 - DNA, 23 bp, Artificial
  Synthethic
auagaaagcgaucaugucauaag

SEQ ID NO: 1335 - DNA, 21 bp, Artificial
  Synthethic
augacaugaucgcuuucuaca

SEQ ID NO: 1336 - DNA, 23 bp, Artificial
  Synthethic
uguagaaagcgaucaugucauaa

SEQ ID NO: 1337 - DNA, 21 bp, Artificial
  Synthethic
ugacaugaucgcuuucuacau

SEQ ID NO: 1338 - DNA, 23 bp, Artificial
  Synthethic
auguagaaagcgaucaugucaua

SEQ ID NO: 1339 - DNA, 21 bp, Artificial
  Synthethic
caugaucgcuuucuacacugu

SEQ ID NO: 1340 - DNA, 23 bp, Artificial
  Synthethic
acagugtagaaagcgaucauguc

SEQ ID NO: 1341 - DNA, 21 bp, Artificial
  Synthethic
ugaucgcuuucuacacuguau

SEQ ID NO: 1342 - DNA, 23 bp, Artificial
  Synthethic
auacagtguagaaagcgaucaug

SEQ ID NO: 1343 - DNA, 21 bp, Artificial
  Synthethic
gaucgcuuucuacacuguauu

SEQ ID NO: 1344 - DNA, 23 bp, Artificial
  Synthethic
aauacaguguagaaagcgaucau

SEQ ID NO: 1345 - DNA, 21 bp, Artificial
  Synthethic
aucgcuuucuacacuguauua

SEQ ID NO: 1346 - DNA, 23 bp, Artificial
  Synthethic
uaauacaguguagaaagcgauca

SEQ ID NO: 1347 - DNA, 21 bp, Artificial
  Synthethic
ucgcuuucuacacuguauuau

SEQ ID NO: 1348 - DNA, 23 bp, Artificial
  Synthethic
auaauacaguguagaaagcgauc

SEQ ID NO: 1349 - DNA, 21 bp, Artificial
  Synthethic
cgcuuucuacacuguauuaca

SEQ ID NO: 1350 - DNA, 23 bp, Artificial
  Synthethic
uguaauacaguguagaaagcgau

SEQ ID NO: 1351 - DNA, 21 bp, Artificial
  Synthethic
cuuucuacacuguauuacaua

SEQ ID NO: 1352 - DNA, 23 bp, Artificial
  Synthethic
uauguaauacaguguagaaagcg

SEQ ID NO: 1353 - DNA, 21 bp, Artificial
  Synthethic
uucuacacuguauuacauaaa

SEQ ID NO: 1354 - DNA, 23 bp, Artificial
  Synthethic
uuuaugtaauacaguguagaaag

SEQ ID NO: 1355 - DNA, 21 bp, Artificial
  Synthethic
ucuacacuguauuacauaaau

SEQ ID NO: 1356 - DNA, 23 bp, Artificial
  Synthethic
auuuauguaauacaguguagaaa

SEQ ID NO: 1357 - DNA, 21 bp, Artificial
  Synthethic
gauucaauuuucuuuaaccau

SEQ ID NO: 1358 - DNA, 23 bp, Artificial
  Synthethic
augguuaaagaaaauugaaucug

SEQ ID NO: 1359 - DNA, 21 bp, Artificial
  Synthethic
auuuucuuuaaccagucugaa

SEQ ID NO: 1360 - DNA, 23 bp, Artificial
  Synthethic
uucagacugguuaaagaaaauug

SEQ ID NO: 1361 - DNA, 21 bp, Artificial
  Synthethic
uuucuuuaaccagucugaagu

SEQ ID NO: 1362 - DNA, 23 bp, Artificial
  Synthethic
acuucagacugguuaaagaaaau

SEQ ID NO: 1363 - DNA, 21 bp, Artificial
  Synthethic
ucuuuaaccagucugaaguuu

SEQ ID NO: 1364 - DNA, 23 bp, Artificial
  Synthethic
aaacuucagacugguuaaagaaa

SEQ ID NO: 1365 - DNA, 21 bp, Artificial
  Synthethic
cuuuaaccagucugaaguuuc

SEQ ID NO: 1366 - DNA, 23 bp, Artificial
  Synthethic
gaaacutcagacugguuaaagaa

SEQ ID NO: 1367 - DNA, 21 bp, Artificial
  Synthethic
cugaaguuucauuuaugauau

SEQ ID NO: 1368 - DNA, 23 bp, Artificial
  Synthethic
auaucataaaugaaacuucagac

SEQ ID NO: 1369 - DNA, 21 bp, Artificial
  Synthethic
gaaguuucauuuaugauacaa

SEQ ID NO: 1370 - DNA, 23 bp, Artificial
  Synthethic
uuguaucauaaaugaaacuucag

SEQ ID NO: 1371 - DNA, 21 bp, Artificial
  Synthethic
aaauggaaguggcaauauaau

SEQ ID NO: 1372 - DNA, 23 bp, Artificial
  Synthethic
auuauatugccacuuccauuuuc

SEQ ID NO: 1373 - DNA, 21 bp, Artificial
  Synthethic
auggaaguggcaauauaaggu

SEQ ID NO: 1374 - DNA, 23 bp, Artificial
  Synthethic
accuuatauugccacuuccauuu

SEQ ID NO: 1375 - DNA, 21 bp, Artificial
  Synthethic
ugccuggacaaacccuucuuu

SEQ ID NO: 1376 - DNA, 23 bp, Artificial
  Synthethic
aaagaaggguuuguccaggcaug

SEQ ID NO: 1377 - DNA, 21 bp, Artificial
  Synthethic
uucuuuuaagaugugucuuca

SEQ ID NO: 1378 - DNA, 23 bp, Artificial
  Synthethic
ugaagacacaucuuaaaagaagg

SEQ ID NO: 1379 - DNA, 21 bp, Artificial
  Synthethic
cuuuuaagaugugucuucaau

SEQ ID NO: 1380 - DNA, 23 bp, Artificial
  Synthethic
auugaagacacaucuuaaaagaa

SEQ ID NO: 1381 - DNA, 21 bp, Artificial
  Synthethic
uuuuaagaugugucuucaauu

SEQ ID NO: 1382 - DNA, 23 bp, Artificial
  Synthethic
aauugaagacacaucuuaaaaga

SEQ ID NO: 1383 - DNA, 21 bp, Artificial
  Synthethic
uuuaagaugugucuucaauuu

SEQ ID NO: 1384 - DNA, 23 bp, Artificial
  Synthethic
aaauugaagacacaucuuaaaag

SEQ ID NO: 1385 - DNA, 21 bp, Artificial
  Synthethic
uuaagaugugucuucaauuug

SEQ ID NO: 1386 - DNA, 23 bp, Artificial
  Synthethic
caaauugaagacacaucuuaaaa

SEQ ID NO: 1387 - DNA, 21 bp, Artificial
  Synthethic
uaagaugugucuucaauuugu

SEQ ID NO: 1388 - DNA, 23 bp, Artificial
  Synthethic
acaaautgaagacacaucuuaaa

SEQ ID NO: 1389 - DNA, 21 bp, Artificial
  Synthethic
aagaugugucuucaauuugua

SEQ ID NO: 1390 - DNA, 23 bp, Artificial
  Synthethic
uacaaatugaagacacaucuuaa

SEQ ID NO: 1391 - DNA, 21 bp, Artificial
  Synthethic
agaugugucuucaauuuguau

SEQ ID NO: 1392 - DNA, 23 bp, Artificial
  Synthethic
auacaaauugaagacacaucuua

SEQ ID NO: 1393 - DNA, 21 bp, Artificial
  Synthethic
augugucuucaauuuguauaa

SEQ ID NO: 1394 - DNA, 23 bp, Artificial
  Synthethic
uuauacaaauugaagacacaucu

SEQ ID NO: 1395 - DNA, 21 bp, Artificial
  Synthethic
ugucuucaauuuguauaaaau

SEQ ID NO: 1396 - DNA, 23 bp, Artificial
  Synthethic
auuuuatacaaauugaagacaca

SEQ ID NO: 1397 - DNA, 21 bp, Artificial
  Synthethic
cuucaauuuguauaaaauggu

SEQ ID NO: 1398 - DNA, 23 bp, Artificial
  Synthethic
accauutuauacaaauugaagac

SEQ ID NO: 1399 - DNA, 21 bp, Artificial
  Synthethic
augguguuuucauguaaauaa

SEQ ID NO: 1400 - DNA, 23 bp, Artificial
  Synthethic
uuauuuacaugaaaacaccauuu

SEQ ID NO: 1401 - DNA, 21 bp, Artificial
  Synthethic
guaaauaaauacauucuugga

SEQ ID NO: 1402 - DNA, 23 bp, Artificial
  Synthethic
uccaagaauguauuuauuuacau

SEQ ID NO: 1403 - DNA, 21 bp, Artificial
  Synthethic
cauguucugugguaaacucaa

SEQ ID NO: 1404 - DNA, 23 bp, Artificial
  Synthethic
uugaguuuaccacagaacauggc

SEQ ID NO: 1405 - RNA, 23 nt, Artificial
  Synthethic
gccauguucugugguaaacucaa

SEQ ID NO: 1406 - DNA, 21 bp, Artificial
  Synthethic
uguucugugguaaacucaaca

SEQ ID NO: 1407 - DNA, 23 bp, Artificial
  Synthethic
uguugaguuuaccacagaacaug

SEQ ID NO: 1408 - RNA, 23 nt, Artificial
  Synthethic
cauguucugugguaaacucaaca

SEQ ID NO: 1409 - DNA, 21 bp, Artificial
  Synthethic
auguucugugguaaacucaaa

SEQ ID NO: 1410 - DNA, 23 bp, Artificial
  Synthethic
uuugaguuuaccacagaacaugg

SEQ ID NO: 1411 - RNA, 23 nt, Artificial
  Synthethic
ccauguucugugguaaacucaac

SEQ ID NO: 1412 - DNA, 21 bp, Artificial
  Synthethic
cugugguaaacucaacaugca

SEQ ID NO: 1413 - DNA, 23 bp, Artificial
  Synthethic
ugcauguugaguuuaccacagaa

SEQ ID NO: 1414 - RNA, 23 nt, Artificial
  Synthethic
uucugugguaaacucaacaugca

SEQ ID NO: 1415 - DNA, 21 bp, Artificial
  Synthethic
gguaaacucaacaugcacaua

SEQ ID NO: 1416 - DNA, 23 bp, Artificial
  Synthethic
uaugugcauguugaguuuaccac

SEQ ID NO: 1417 - RNA, 23 nt, Artificial
  Synthethic
gugguaaacucaacaugcacaug

SEQ ID NO: 1418 - DNA, 21 bp, Artificial
  Synthethic
ugugguaaacucaacaugcaa

SEQ ID NO: 1419 - DNA, 23 bp, Artificial
  Synthethic
uugcauguugaguuuaccacaga

SEQ ID NO: 1420 - RNA, 23 nt, Artificial
  Synthethic
ucugugguaaacucaacaugcac

SEQ ID NO: 1421 - DNA, 21 bp, Artificial
  Synthethic
gaagagcacuaacuugcacga

SEQ ID NO: 1422 - DNA, 23 bp, Artificial
  Synthethic
ucgugcaaguuagugcucuucuc

SEQ ID NO: 1423 - RNA, 23 nt, Artificial
  Synthethic
gagaagagcacuaacuugcacga

SEQ ID NO: 1424 - DNA, 21 bp, Artificial
  Synthethic
ccgcugguacuuugaugucaa

SEQ ID NO: 1425 - DNA, 23 bp, Artificial
  Synthethic
uugacaucaaaguaccagcggga

SEQ ID NO: 1426 - RNA, 23 nt, Artificial
  Synthethic
ucccgcugguacuuugaugucac

SEQ ID NO: 1427 - DNA, 21 bp, Artificial
  Synthethic
ccauguucugugguaaacuca

SEQ ID NO: 1428 - DNA, 23 bp, Artificial
  Synthethic
ugaguuuaccacagaacauggcg

SEQ ID NO: 1429 - RNA, 23 nt, Artificial
  Synthethic
cgccauguucugugguaaacuca

SEQ ID NO: 1430 - DNA, 21 bp, Artificial
  Synthethic
gugguaaacucaacaugcaca

SEQ ID NO: 1431 - DNA, 23 bp, Artificial
  Synthethic
ugugcauguugaguuuaccacag

SEQ ID NO: 1432 - RNA, 23 nt, Artificial
  Synthethic
cugugguaaacucaacaugcaca

SEQ ID NO: 1433 - DNA, 21 bp, Artificial
  Synthethic
gaacugcagaucacaaacgua

SEQ ID NO: 1434 - DNA, 23 bp, Artificial
  Synthethic
uacguuugugaucugcaguucag

SEQ ID NO: 1435 - RNA, 23 nt, Artificial
  Synthethic
cugaacugcagaucacaaacgug

SEQ ID NO: 1436 - DNA, 21 bp, Artificial
  Synthethic
aagagcacuaacuugcacgaa

SEQ ID NO: 1437 - DNA, 23 bp, Artificial
  Synthethic
uucgugcaaguuagugcucuucu

SEQ ID NO: 1438 - RNA, 23 nt, Artificial
  Synthethic
agaagagcacuaacuugcacgac

SEQ ID NO: 1439 - DNA, 21 bp, Artificial
  Synthethic
agcacuaacuugcacgacuaa

SEQ ID NO: 1440 - DNA, 23 bp, Artificial
  Synthethic
uuagucgugcaaguuagugcucu

SEQ ID NO: 1441 - RNA, 23 nt, Artificial
  Synthethic
agagcacuaacuugcacgacuau

SEQ ID NO: 1442 - DNA, 21 bp, Artificial
  Synthethic
gcacuaacuugcacgacuaua

SEQ ID NO: 1443 - DNA, 23 bp, Artificial
  Synthethic
uauagucgugcaaguuagugcuc

SEQ ID NO: 1444 - RNA, 23 nt, Artificial
  Synthethic
gagcacuaacuugcacgacuaug

SEQ ID NO: 1445 - DNA, 21 bp, Artificial
  Synthethic
aaaguuuacucaagacuacca

SEQ ID NO: 1446 - DNA, 23 bp, Artificial
  Synthethic
ugguagucuugaguaaacuuugg

SEQ ID NO: 1447 - RNA, 23 nt, Artificial
  Synthethic
ccaaaguuuacucaagacuacca

SEQ ID NO: 1448 - DNA, 21 bp, Artificial
  Synthethic
cgcaugaaccagucucuguca

SEQ ID NO: 1449 - DNA, 23 bp, Artificial
  Synthethic
ugacagagacugguucaugcgcu

SEQ ID NO: 1450 - RNA, 23 nt, Artificial
  Synthethic
agcgcaugaaccagucucugucc

SEQ ID NO: 1451 - DNA, 21 bp, Artificial
  Synthethic
cacaucgugauuccuuaccga

SEQ ID NO: 1452 - DNA, 23 bp, Artificial
  Synthethic
ucgguaaggaaucacgauguggg

SEQ ID NO: 1453 - RNA, 23 nt, Artificial
  Synthethic
cccacaucgugauuccuuaccgu

SEQ ID NO: 1454 - DNA, 21 bp, Artificial
  Synthethic
augcugaagaaguacguccga

SEQ ID NO: 1455 - DNA, 23 bp, Artificial
  Synthethic
ucggacguacuucuucagcaugu

SEQ ID NO: 1456 - RNA, 23 nt, Artificial
  Synthethic
acaugcugaagaaguacguccgu

SEQ ID NO: 1457 - DNA, 21 bp, Artificial
  Synthethic
gagcgcaugaaccagucucua

SEQ ID NO: 1458 - DNA, 23 bp, Artificial
  Synthethic
uagagacugguucaugcgcucgu

SEQ ID NO: 1459 - RNA, 23 nt, Artificial
  Synthethic
acgagcgcaugaaccagucucug

SEQ ID NO: 1460 - DNA, 21 bp, Artificial
  Synthethic
gagcagaacuacuccgacgaa

SEQ ID NO: 1461 - DNA, 23 bp, Artificial
  Synthethic
uucgucggaguaguucugcuccu

SEQ ID NO: 1462 - RNA, 23 nt, Artificial
  Synthethic
aggagcagaacuacuccgacgau

SEQ ID NO: 1463 - DNA, 21 bp, Artificial
  Synthethic
cacccacaucgugauuccuua

SEQ ID NO: 1464 - DNA, 23 bp, Artificial
  Synthethic
uaaggaaucacgaugugggugug

SEQ ID NO: 1465 - RNA, 23 nt, Artificial
  Synthethic
cacacccacaucgugauuccuua

SEQ ID NO: 1466 - DNA, 21 bp, Artificial
  Synthethic
agagcacuaacuugcacgaca

SEQ ID NO: 1467 - DNA, 23 bp, Artificial
  Synthethic
ugucgugcaaguuagugcucuuc

SEQ ID NO: 1468 - RNA, 23 nt, Artificial
  Synthethic
gaagagcacuaacuugcacgacu

SEQ ID NO: 1469 - DNA, 21 bp, Artificial
  Synthethic
cacuaacuugcacgacuauga

SEQ ID NO: 1470 - DNA, 23 bp, Artificial
  Synthethic
ucauagucgugcaaguuagugcu

SEQ ID NO: 1471 - RNA, 23 nt, Artificial
  Synthethic
agcacuaacuugcacgacuaugg

SEQ ID NO: 1472 - DNA, 21 bp, Artificial
  Synthethic
cucaagacuaccagugaacca

SEQ ID NO: 1473 - DNA, 23 bp, Artificial
  Synthethic
ugguucacugguagucuugagua

SEQ ID NO: 1474 - RNA, 23 nt, Artificial
  Synthethic
uacucaagacuaccagugaaccu

SEQ ID NO: 1475 - DNA, 21 bp, Artificial
  Synthethic
agcacacccuaaagcauuuua

SEQ ID NO: 1476 - DNA, 23 bp, Artificial
  Synthethic
uaaaaugcuuuagggugugcugu

SEQ ID NO: 1477 - RNA, 23 nt, Artificial
  Synthethic
acagcacacccuaaagcauuuug

SEQ ID NO: 1478 - DNA, 21 bp, Artificial
  Synthethic
aaggagcagaacuacuccgaa

SEQ ID NO: 1479 - DNA, 23 bp, Artificial
  Synthethic
uucggaguaguucugcuccuucu

SEQ ID NO: 1480 - RNA, 23 nt, Artificial
  Synthethic
agaaggagcagaacuacuccgac

SEQ ID NO: 1481 - DNA, 21 bp, Artificial
  Synthethic
ggagcagaacuacuccgacga

SEQ ID NO: 1482 - DNA, 23 bp, Artificial
  Synthethic
ucgucggaguaguucugcuccuu

SEQ ID NO: 1483 - RNA, 23 nt, Artificial
  Synthethic
aaggagcagaacuacuccgacga

SEQ ID NO: 1484 - DNA, 21 bp, Artificial
  Synthethic
gaaacaguacacauccaucca

SEQ ID NO: 1485 - DNA, 23 bp, Artificial
  Synthethic
uggauggauguguacuguuucuu

SEQ ID NO: 1486 - RNA, 23 nt, Artificial
  Synthethic
aagaaacaguacacauccaucca

SEQ ID NO: 1487 - DNA, 21 bp, Artificial
  Synthethic
cugaacugcagaucacaaaca

SEQ ID NO: 1488 - DNA, 23 bp, Artificial
  Synthethic
uguuugugaucugcaguucaggg

SEQ ID NO: 1489 - RNA, 23 nt, Artificial
  Synthethic
cccugaacugcagaucacaaacg

SEQ ID NO: 1490 - DNA, 21 bp, Artificial
  Synthethic
ccacaucgugauuccuuacca

SEQ ID NO: 1491 - DNA, 23 bp, Artificial
  Synthethic
ugguaaggaaucacgaugugggu

SEQ ID NO: 1492 - RNA, 23 nt, Artificial
  Synthethic
acccacaucgugauuccuuaccg

SEQ ID NO: 1493 - DNA, 21 bp, Artificial
  Synthethic
gugcccgacaagugcaaguua

SEQ ID NO: 1494 - DNA, 23 bp, Artificial
  Synthethic
uaacuugcacuugucgggcacga

SEQ ID NO: 1495 - RNA, 23 nt, Artificial
  Synthethic
ucgugcccgacaagugcaaguuc

SEQ ID NO: 1496 - DNA, 21 bp, Artificial
  Synthethic
gacuaccagugaaccucuuca

SEQ ID NO: 1497 - DNA, 23 bp, Artificial
  Synthethic
ugaagagguucacugguagucuu

SEQ ID NO: 1498 - RNA, 23 nt, Artificial
  Synthethic
aagacuaccagugaaccucuucc

SEQ ID NO: 1499 - DNA, 21 bp, Artificial
  Synthethic
guccgccaucaaaaacuggua

SEQ ID NO: 1500 - DNA, 23 bp, Artificial
  Synthethic
uaccaguuuuugauggcggacuu

SEQ ID NO: 1501 - RNA, 23 nt, Artificial
  Synthethic
aaguccgccaucaaaaacuggug

SEQ ID NO: 1502 - DNA, 21 bp, Artificial
  Synthethic
ggcccucgagaauuacaucaa

SEQ ID NO: 1503 - DNA, 23 bp, Artificial
  Synthethic
uugauguaauucucgagggccag

SEQ ID NO: 1504 - RNA, 23 nt, Artificial
  Synthethic
cuggcccucgagaauuacaucac

SEQ ID NO: 1505 - DNA, 21 bp, Artificial
  Synthethic
caugcugaagaaguacgucca

SEQ ID NO: 1506 - DNA, 23 bp, Artificial
  Synthethic
uggacguacuucuucagcauguu

SEQ ID NO: 1507 - RNA, 23 nt, Artificial
  Synthethic
aacaugcugaagaaguacguccg

SEQ ID NO: 1508 - DNA, 21 bp, Artificial
  Synthethic
ugcugaagaaguacguccgua

SEQ ID NO: 1509 - DNA, 23 bp, Artificial
  Synthethic
uacggacguacuucuucagcaug

SEQ ID NO: 1510 - RNA, 23 nt, Artificial
  Synthethic
caugcugaagaaguacguccgug

SEQ ID NO: 1511 - DNA, 21 bp, Artificial
  Synthethic
uccgccaucaaaaacugguga

SEQ ID NO: 1512 - DNA, 23 bp, Artificial
  Synthethic
ucaccaguuuuugauggcggacu

SEQ ID NO: 1513 - RNA, 23 nt, Artificial
  Synthethic
aguccgccaucaaaaacuggugu

SEQ ID NO: 1514 - DNA, 21 bp, Artificial
  Synthethic
uugcacgacuauggcaugcua

SEQ ID NO: 1515 - DNA, 23 bp, Artificial
  Synthethic
uagcaugccauagucgugcaagu

SEQ ID NO: 1516 - RNA, 23 nt, Artificial
  Synthethic
acuugcacgacuauggcaugcug

SEQ ID NO: 1517 - DNA, 21 bp, Artificial
  Synthethic
ucccaggucaugagagaauga

SEQ ID NO: 1518 - DNA, 23 bp, Artificial
  Synthethic
ucauucucucaugaccugggaca

SEQ ID NO: 1519 - RNA, 23 nt, Artificial
  Synthethic
ugucccaggucaugagagaaugg

SEQ ID NO: 1520 - DNA, 21 bp, Artificial
  Synthethic
cugaagaaguacguccgugca

SEQ ID NO: 1521 - DNA, 23 bp, Artificial
  Synthethic
ugcacggacguacuucuucagca

SEQ ID NO: 1522 - RNA, 23 nt, Artificial
  Synthethic
ugcugaagaaguacguccgugcg

SEQ ID NO: 1523 - DNA, 21 bp, Artificial
  Synthethic
cgugugaucuacgagcgcaua

SEQ ID NO: 1524 - DNA, 23 bp, Artificial
  Synthethic
uaugcgcucguagaucacacgga

SEQ ID NO: 1525 - RNA, 23 nt, Artificial
  Synthethic
uccgugugaucuacgagcgcaug

SEQ ID NO: 1526 - DNA, 21 bp, Artificial
  Synthethic
uacugccaagaggucuaccca

SEQ ID NO: 1527 - DNA, 23 bp, Artificial
  Synthethic
uggguagaccucuuggcaguacu

SEQ ID NO: 1528 - RNA, 23 nt, Artificial
  Synthethic
aguacugccaagaggucuacccu

SEQ ID NO: 1529 - DNA, 21 bp, Artificial
  Synthethic
caccgagagagaaugucccaa

SEQ ID NO: 1530 - DNA, 23 bp, Artificial
  Synthethic
uugggacauucucucucggugcu

SEQ ID NO: 1531 - RNA, 23 nt, Artificial
  Synthethic
agcaccgagagagaaugucccag

SEQ ID NO: 1532 - DNA, 21 bp, Artificial
  Synthethic
caaggccucaucauguguuca

SEQ ID NO: 1533 - DNA, 23 bp, Artificial
  Synthethic
ugaacacaugaugaggccuuggg

SEQ ID NO: 1534 - RNA, 23 nt, Artificial
  Synthethic
cccaaggccucaucauguguuca

SEQ ID NO: 1535 - DNA, 21 bp, Artificial
  Synthethic
gcugaagaaguacguccguga

SEQ ID NO: 1536 - DNA, 23 bp, Artificial
  Synthethic
ucacggacguacuucuucagcau

SEQ ID NO: 1537 - RNA, 23 nt, Artificial
  Synthethic
augcugaagaaguacguccgugc

SEQ ID NO: 1538 - DNA, 21 bp, Artificial
  Synthethic
aagcauuuugaacaugugcga

SEQ ID NO: 1539 - DNA, 23 bp, Artificial
  Synthethic
ucgcacauguucaaaaugcuuua

SEQ ID NO: 1540 - RNA, 23 nt, Artificial
  Synthethic
uaaagcauuuugaacaugugcgc

SEQ ID NO: 1541 - DNA, 21 bp, Artificial
  Synthethic
caccuccgugugaucuacgaa

SEQ ID NO: 1542 - DNA, 23 bp, Artificial
  Synthethic
uucguagaucacacggaggugug

SEQ ID NO: 1543 - RNA, 23 nt, Artificial
  Synthethic
cacaccuccgugugaucuacgag

SEQ ID NO: 1544 - DNA, 21 bp, Artificial
  Synthethic
gaaggagcagaacuacuccga

SEQ ID NO: 1545 - DNA, 23 bp, Artificial
  Synthethic
ucggaguaguucugcuccuucug

SEQ ID NO: 1546 - RNA, 23 nt, Artificial
  Synthethic
cagaaggagcagaacuacuccga

SEQ ID NO: 1547 - DNA, 21 bp, Artificial
  Synthethic
gaagaaacaguacacauccaa

SEQ ID NO: 1548 - DNA, 23 bp, Artificial
  Synthethic
uuggauguguacuguuucuucuu

SEQ ID NO: 1549 - RNA, 23 nt, Artificial
  Synthethic
aagaagaaacaguacacauccau

SEQ ID NO: 1550 - DNA, 21 bp, Artificial
  Synthethic
guacugccaagaggucuacca

SEQ ID NO: 1551 - DNA, 23 bp, Artificial
  Synthethic
ugguagaccucuuggcaguacug

SEQ ID NO: 1552 - RNA, 23 nt, Artificial
  Synthethic
caguacugccaagaggucuaccc

SEQ ID NO: 1553 - DNA, 21 bp, Artificial
  Synthethic
acugccaagaggucuacccua

SEQ ID NO: 1554 - DNA, 23 bp, Artificial
  Synthethic
uaggguagaccucuuggcaguac

SEQ ID NO: 1555 - RNA, 23 nt, Artificial
  Synthethic
guacugccaagaggucuacccug

SEQ ID NO: 1556 - DNA, 21 bp, Artificial
  Synthethic
acuaacuugcacgacuaugga

SEQ ID NO: 1557 - DNA, 23 bp, Artificial
  Synthethic
uccauagucgugcaaguuagugc

SEQ ID NO: 1558 - RNA, 23 nt, Artificial
  Synthethic
gcacuaacuugcacgacuauggc

SEQ ID NO: 1559 - DNA, 21 bp, Artificial
  Synthethic
gucccauucuuuuacggcgga

SEQ ID NO: 1560 - DNA, 23 bp, Artificial
  Synthethic
uccgccguaaaagaaugggacac

SEQ ID NO: 1561 - RNA, 23 nt, Artificial
  Synthethic
gugucccauucuuuuacggcgga

SEQ ID NO: 1562 - DNA, 21 bp, Artificial
  Synthethic
aagcugacaagaaggccguua

SEQ ID NO: 1563 - DNA, 23 bp, Artificial
  Synthethic
uaacggccuucuugucagcuuug

SEQ ID NO: 1564 - RNA, 23 nt, Artificial
  Synthethic
caaagcugacaagaaggccguua

SEQ ID NO: 1565 - DNA, 21 bp, Artificial
  Synthethic
ugacaagaaggccguuaucca

SEQ ID NO: 1566 - DNA, 23 bp, Artificial
  Synthethic
uggauaacggccuucuugucagc

SEQ ID NO: 1567 - RNA, 23 nt, Artificial
  Synthethic
gcugacaagaaggccguuaucca

SEQ ID NO: 1568 - DNA, 21 bp, Artificial
  Synthethic
agcauuuugaacaugugcgca

SEQ ID NO: 1569 - DNA, 23 bp, Artificial
  Synthethic
ugcgcacauguucaaaaugcuuu

SEQ ID NO: 1570 - RNA, 23 nt, Artificial
  Synthethic
aaagcauuuugaacaugugcgca

SEQ ID NO: 1571 - DNA, 21 bp, Artificial
  Synthethic
ugugaucuacgagcgcaugaa

SEQ ID NO: 1572 - DNA, 23 bp, Artificial
  Synthethic
uucaugcgcucguagaucacacg

SEQ ID NO: 1573 - RNA, 23 nt, Artificial
  Synthethic
cgugugaucuacgagcgcaugaa

SEQ ID NO: 1574 - DNA, 21 bp, Artificial
  Synthethic
cagcgagaagagcacuaacua

SEQ ID NO: 1575 - DNA, 23 bp, Artificial
  Synthethic
uaguuagugcucuucucgcugca

SEQ ID NO: 1576 - RNA, 23 nt, Artificial
  Synthethic
ugcagcgagaagagcacuaacuu

SEQ ID NO: 1577 - DNA, 21 bp, Artificial
  Synthethic
agcgugucaacccaaaguuua

SEQ ID NO: 1578 - DNA, 23 bp, Artificial
  Synthethic
uaaacuuuggguugacacgcugc

SEQ ID NO: 1579 - RNA, 23 nt, Artificial
  Synthethic
gcagcgugucaacccaaaguuua

SEQ ID NO: 1580 - DNA, 21 bp, Artificial
  Synthethic
ugucaacccaaaguuuacuca

SEQ ID NO: 1581 - DNA, 23 bp, Artificial
  Synthethic
ugaguaaacuuuggguugacacg

SEQ ID NO: 1582 - RNA, 23 nt, Artificial
  Synthethic
cgugucaacccaaaguuuacuca

SEQ ID NO: 1583 - DNA, 21 bp, Artificial
  Synthethic
ugucccauucuuuuacggcga

SEQ ID NO: 1584 - DNA, 23 bp, Artificial
  Synthethic
ucgccguaaaagaaugggacaca

SEQ ID NO: 1585 - RNA, 23 nt, Artificial
  Synthethic
ugugucccauucuuuuacggcgg

SEQ ID NO: 1586 - DNA, 21 bp, Artificial
  Synthethic
gugucaacccaaaguuuacua

SEQ ID NO: 1587 - DNA, 23 bp, Artificial
  Synthethic
uaguaaacuuuggguugacacgc

SEQ ID NO: 1588 - RNA, 23 nt, Artificial
  Synthethic
gcgugucaacccaaaguuuacuc

SEQ ID NO: 1589 - DNA, 21 bp, Artificial
  Synthethic
aagauccugauaaacuuccca

SEQ ID NO: 1590 - DNA, 23 bp, Artificial
  Synthethic
ugggaaguuuaucaggaucuugg

SEQ ID NO: 1591 - RNA, 23 nt, Artificial
  Synthethic
ccaagauccugauaaacuuccca

SEQ ID NO: 1592 - DNA, 21 bp, Artificial
  Synthethic
agauccugauaaacuucccaa

SEQ ID NO: 1593 - DNA, 23 bp, Artificial
  Synthethic
uugggaaguuuaucaggaucuug

SEQ ID NO: 1594 - RNA, 23 nt, Artificial
  Synthethic
caagauccugauaaacuucccac

SEQ ID NO: 1595 - DNA, 21 bp, Artificial
  Synthethic
cuuaccguugccuaguuggua

SEQ ID NO: 1596 - DNA, 23 bp, Artificial
  Synthethic
uaccaacuaggcaacgguaagga

SEQ ID NO: 1597 - RNA, 23 nt, Artificial
  Synthethic
uccuuaccguugccuaguuggug

SEQ ID NO: 1598 - DNA, 21 bp, Artificial
  Synthethic
gugugucccauucuuuuacga

SEQ ID NO: 1599 - DNA, 23 bp, Artificial
  Synthethic
ucguaaaagaaugggacacacuu

SEQ ID NO: 1600 - RNA, 23 nt, Artificial
  Synthethic
aagugugucccauucuuuuacgg

SEQ ID NO: 1601 - DNA, 21 bp, Artificial
  Synthethic
gugucccauucuuuuacggca

SEQ ID NO: 1602 - DNA, 23 bp, Artificial
  Synthethic
ugccguaaaagaaugggacacac

SEQ ID NO: 1603 - RNA, 23 nt, Artificial
  Synthethic
gugugucccauucuuuuacggcg

SEQ ID NO: 1604 - DNA, 21 bp, Artificial
  Synthethic
cauagcaaccgugauugucaa

SEQ ID NO: 1605 - DNA, 23 bp, Artificial
  Synthethic
uugacaaucacgguugcuaugac

SEQ ID NO: 1606 - RNA, 23 nt, Artificial
  Synthethic
gucauagcaaccgugauugucau

SEQ ID NO: 1607 - DNA, 21 bp, Artificial
  Synthethic
gaacggauaugagaauccaaa

SEQ ID NO: 1608 - DNA, 23 bp, Artificial
  Synthethic
uuuggauucucauauccguucug

SEQ ID NO: 1609 - RNA, 23 nt, Artificial
  Synthethic
cagaacggauaugagaauccaac

SEQ ID NO: 1610 - DNA, 21 bp, Artificial
  Synthethic
ugugucccauucuuuuacgga

SEQ ID NO: 1611 - DNA, 23 bp, Artificial
  Synthethic
uccguaaaagaaugggacacacu

SEQ ID NO: 1612 - RNA, 23 nt, Artificial
  Synthethic
agugugucccauucuuuuacggc

SEQ ID NO: 1613 - DNA, 21 bp, Artificial
  Synthethic
gcaaccgugauugucaucaca

SEQ ID NO: 1614 - DNA, 23 bp, Artificial
  Synthethic
ugugaugacaaucacgguugcua

SEQ ID NO: 1615 - RNA, 23 nt, Artificial
  Synthethic
uagcaaccgugauugucaucacc

SEQ ID NO: 1616 - DNA, 21 bp, Artificial
  Synthethic
gcagcgagaagagcacuaaca

SEQ ID NO: 1617 - DNA, 23 bp, Artificial
  Synthethic
uguuagugcucuucucgcugcau

SEQ ID NO: 1618 - RNA, 23 nt, Artificial
  Synthethic
augcagcgagaagagcacuaacu

SEQ ID NO: 1619 - DNA, 21 bp, Artificial
  Synthethic
cagaauucggacaugauucaa

SEQ ID NO: 1620 - DNA, 23 bp, Artificial
  Synthethic
uugaaucauguccgaauucugca

SEQ ID NO: 1621 - RNA, 23 nt, Artificial
  Synthethic
ugcagaauucggacaugauucag

SEQ ID NO: 1622 - DNA, 21 bp, Artificial
  Synthethic
uccugauaaacuucccacgaa

SEQ ID NO: 1623 - DNA, 23 bp, Artificial
  Synthethic
uucgugggaaguuuaucaggauc

SEQ ID NO: 1624 - RNA, 23 nt, Artificial
  Synthethic
gauccugauaaacuucccacgac

SEQ ID NO: 1625 - DNA, 21 bp, Artificial
  Synthethic
agaacggauaugagaauccaa

SEQ ID NO: 1626 - DNA, 23 bp, Artificial
  Synthethic
uuggauucucauauccguucugc

SEQ ID NO: 1627 - RNA, 23 nt, Artificial
  Synthethic
gcagaacggauaugagaauccaa

SEQ ID NO: 1628 - DNA, 21 bp, Artificial
  Synthethic
ccuuaccguugccuaguugga

SEQ ID NO: 1629 - DNA, 23 bp, Artificial
  Synthethic
uccaacuaggcaacgguaaggaa

SEQ ID NO: 1630 - RNA, 23 nt, Artificial
  Synthethic
uuccuuaccguugccuaguuggu

SEQ ID NO: 1631 - DNA, 21 bp, Artificial
  Synthethic
auccugauaaacuucccacga

SEQ ID NO: 1632 - DNA, 23 bp, Artificial
  Synthethic
ucgugggaaguuuaucaggaucu

SEQ ID NO: 1633 - RNA, 23 nt, Artificial
  Synthethic
agauccugauaaacuucccacga

SEQ ID NO: 1634 - DNA, 21 bp, Artificial
  Synthethic
ccugauaaacuucccacgaca

SEQ ID NO: 1635 - DNA, 23 bp, Artificial
  Synthethic
ugucgugggaaguuuaucaggau

SEQ ID NO: 1636 - RNA, 23 nt, Artificial
  Synthethic
auccugauaaacuucccacgaca

SEQ ID NO: 1637 - DNA, 21 bp, Artificial
  Synthethic
cggauggauguuugugagaca

SEQ ID NO: 1638 - DNA, 23 bp, Artificial
  Synthethic
ugucucacaaacauccauccgcu

SEQ ID NO: 1639 - RNA, 23 nt, Artificial
  Synthethic
agcggauggauguuugugagacc

SEQ ID NO: 1640 - DNA, 21 bp, Artificial
  Synthethic
gacacggaagaguacugcaua

SEQ ID NO: 1641 - DNA, 23 bp, Artificial
  Synthethic
uaugcaguacucuuccgugucaa

SEQ ID NO: 1642 - RNA, 23 nt, Artificial
  Synthethic
uugacacggaagaguacugcaug

SEQ ID NO: 1643 - DNA, 21 bp, Artificial
  Synthethic
gcagcagaacggauaugagaa

SEQ ID NO: 1644 - DNA, 23 bp, Artificial
  Synthethic
uucucauauccguucugcugcau

SEQ ID NO: 1645 - RNA, 23 nt, Artificial
  Synthethic
augcagcagaacggauaugagaa

SEQ ID NO: 1646 - DNA, 21 bp, Artificial
  Synthethic
gcagaacggauaugagaauca

SEQ ID NO: 1647 - DNA, 23 bp, Artificial
  Synthethic
ugauucucauauccguucugcug

SEQ ID NO: 1648 - RNA, 23 nt, Artificial
  Synthethic
cagcagaacggauaugagaaucc

SEQ ID NO: 1649 - DNA, 21 bp, Artificial
  Synthethic
cagaacggauaugagaaucca

SEQ ID NO: 1650 - DNA, 23 bp, Artificial
  Synthethic
uggauucucauauccguucugcu

SEQ ID NO: 1651 - RNA, 23 nt, Artificial
  Synthethic
agcagaacggauaugagaaucca

SEQ ID NO: 1652 - DNA, 21 bp, Artificial
  Synthethic
accgucgccaaagagacauga

SEQ ID NO: 1653 - DNA, 23 bp, Artificial
  Synthethic
ucaugucucuuuggcgacggugu

SEQ ID NO: 1654 - RNA, 23 nt, Artificial
  Synthethic
acaccgucgccaaagagacaugc

SEQ ID NO: 1655 - DNA, 21 bp, Artificial
  Synthethic
guucugugguaaacucaacaa

SEQ ID NO: 1656 - DNA, 23 bp, Artificial
  Synthethic
uuguugaguuuaccacagaacau

SEQ ID NO: 1657 - RNA, 23 nt, Artificial
  Synthethic
auguucugugguaaacucaacau

SEQ ID NO: 1658 - DNA, 21 bp, Artificial
  Synthethic
gguacuuugaugucacugaaa

SEQ ID NO: 1659 - DNA, 23 bp, Artificial
  Synthethic
uuucagugacaucaaaguaccag

SEQ ID NO: 1660 - RNA, 23 nt, Artificial
  Synthethic
cugguacuuugaugucacugaag

SEQ ID NO: 1661 - DNA, 21 bp, Artificial
  Synthethic
cccaaaguuuacucaagacua

SEQ ID NO: 1662 - DNA, 23 bp, Artificial
  Synthethic
uagucuugaguaaacuuuggguu

SEQ ID NO: 1663 - RNA, 23 nt, Artificial
  Synthethic
aacccaaaguuuacucaagacua

SEQ ID NO: 1664 - DNA, 21 bp, Artificial
  Synthethic
ccaaaguuuacucaagacuaa

SEQ ID NO: 1665 - DNA, 23 bp, Artificial
  Synthethic
uuagucuugaguaaacuuugggu

SEQ ID NO: 1666 - RNA, 23 nt, Artificial
  Synthethic
acccaaaguuuacucaagacuac

SEQ ID NO: 1667 - DNA, 21 bp, Artificial
  Synthethic
caucauguguucaacaugcua

SEQ ID NO: 1668 - DNA, 23 bp, Artificial
  Synthethic
uagcauguugaacacaugaugag

SEQ ID NO: 1669 - RNA, 23 nt, Artificial
  Synthethic
cucaucauguguucaacaugcug

SEQ ID NO: 1670 - DNA, 21 bp, Artificial
  Synthethic
aacaugcugaagaaguacgua

SEQ ID NO: 1671 - DNA, 23 bp, Artificial
  Synthethic
uacguacuucuucagcauguuga

SEQ ID NO: 1672 - RNA, 23 nt, Artificial
  Synthethic
ucaacaugcugaagaaguacguc

SEQ ID NO: 1673 - DNA, 21 bp, Artificial
  Synthethic
uucugugguaaacucaacaua

SEQ ID NO: 1674 - DNA, 23 bp, Artificial
  Synthethic
uauguugaguuuaccacagaaca

SEQ ID NO: 1675 - RNA, 23 nt, Artificial
  Synthethic
uguucugugguaaacucaacaug

SEQ ID NO: 1676 - DNA, 21 bp, Artificial
  Synthethic
ucugugguaaacucaacauga

SEQ ID NO: 1677 - DNA, 23 bp, Artificial
  Synthethic
ucauguugaguuuaccacagaac

SEQ ID NO: 1678 - RNA, 23 nt, Artificial
  Synthethic
guucugugguaaacucaacaugc

SEQ ID NO: 1679 - DNA, 21 bp, Artificial
  Synthethic
ccauguucugugguaaacuca

SEQ ID NO: 1680 - DNA, 23 bp, Artificial
  Synthethic
ugaguuuaccacagaacauggcg

SEQ ID NO: 1681 - DNA, 21 bp, Artificial
  Synthethic
cauguucugugguaaacucaa

SEQ ID NO: 1682 - DNA, 23 bp, Artificial
  Synthethic
uugaguuuaccacagaacauggc

SEQ ID NO: 1683 - DNA, 21 bp, Artificial
  Synthethic
auguucugugguaaacucaaa

SEQ ID NO: 1684 - DNA, 23 bp, Artificial
  Synthethic
uuugaguuuaccacagaacaugg

SEQ ID NO: 1685 - DNA, 21 bp, Artificial
  Synthethic
uguucugugguaaacucaaca

SEQ ID NO: 1686 - DNA, 23 bp, Artificial
  Synthethic
uguugaguuuaccacagaacaug

SEQ ID NO: 1687 - DNA, 21 bp, Artificial
  Synthethic
guucugugguaaacucaacaa

SEQ ID NO: 1688 - DNA, 23 bp, Artificial
  Synthethic
uuguugaguuuaccacagaacau

SEQ ID NO: 1689 - DNA, 21 bp, Artificial
  Synthethic
uucugugguaaacucaacaua

SEQ ID NO: 1690 - DNA, 23 bp, Artificial
  Synthethic
uauguugaguuuaccacagaaca

SEQ ID NO: 1691 - DNA, 21 bp, Artificial
  Synthethic
ucugugguaaacucaacauga

SEQ ID NO: 1692 - DNA, 23 bp, Artificial
  Synthethic
ucauguugaguuuaccacagaac

SEQ ID NO: 1693 - DNA, 21 bp, Artificial
  Synthethic
cugugguaaacucaacaugca

SEQ ID NO: 1694 - DNA, 23 bp, Artificial
  Synthethic
ugcauguugaguuuaccacagaa

SEQ ID NO: 1695 - DNA, 21 bp, Artificial
  Synthethic
ugugguaaacucaacaugcaa

SEQ ID NO: 1696 - DNA, 23 bp, Artificial
  Synthethic
uugcauguugaguuuaccacaga

SEQ ID NO: 1697 - DNA, 21 bp, Artificial
  Synthethic
gugguaaacucaacaugcaca

SEQ ID NO: 1698 - DNA, 23 bp, Artificial
  Synthethic
ugugcauguugaguuuaccacag

SEQ ID NO: 1699 - DNA, 21 bp, Artificial
  Synthethic
gguaaacucaacaugcacaua

SEQ ID NO: 1700 - DNA, 23 bp, Artificial
  Synthethic
uaugugcauguugaguuuaccac

SEQ ID NO: 1701 - DNA, 21 bp, Artificial
  Synthethic
guacugccaagaggucuacca

SEQ ID NO: 1702 - DNA, 23 bp, Artificial
  Synthethic
ugguagaccucuuggcaguacug

SEQ ID NO: 1703 - DNA, 21 bp, Artificial
  Synthethic
uacugccaagaggucuaccca

SEQ ID NO: 1704 - DNA, 23 bp, Artificial
  Synthethic
uggguagaccucuuggcaguacu

SEQ ID NO: 1705 - DNA, 21 bp, Artificial
  Synthethic
acugccaagaggucuacccua

SEQ ID NO: 1706 - DNA, 23 bp, Artificial
  Synthethic
uaggguagaccucuuggcaguac

SEQ ID NO: 1707 - DNA, 21 bp, Artificial
  Synthethic
cugaacugcagaucacaaaca

SEQ ID NO: 1708 - DNA, 23 bp, Artificial
  Synthethic
uguuugugaucugcaguucaggg

SEQ ID NO: 1709 - DNA, 21 bp, Artificial
  Synthethic
gaacugcagaucacaaacgua

SEQ ID NO: 1710 - DNA, 23 bp, Artificial
  Synthethic
uacguuugugaucugcaguucag

SEQ ID NO: 1711 - DNA, 21 bp, Artificial
  Synthethic
cacccacaucgugauuccuua

SEQ ID NO: 1712 - DNA, 23 bp, Artificial
  Synthethic
uaaggaaucacgaugugggugug

SEQ ID NO: 1713 - DNA, 21 bp, Artificial
  Synthethic
ccacaucgugauuccuuacca

SEQ ID NO: 1714 - DNA, 23 bp, Artificial
  Synthethic
ugguaaggaaucacgaugugggu

SEQ ID NO: 1715 - DNA, 21 bp, Artificial
  Synthethic
cacaucgugauuccuuaccga

SEQ ID NO: 1716 - DNA, 23 bp, Artificial
  Synthethic
ucgguaaggaaucacgauguggg

SEQ ID NO: 1717 - DNA, 21 bp, Artificial
  Synthethic
ccuuaccguugccuaguugga

SEQ ID NO: 1718 - DNA, 23 bp, Artificial
  Synthethic
uccaacuaggcaacgguaaggaa

SEQ ID NO: 1719 - DNA, 21 bp, Artificial
  Synthethic
cuuaccguugccuaguuggua

SEQ ID NO: 1720 - DNA, 23 bp, Artificial
  Synthethic
uaccaacuaggcaacgguaagga

SEQ ID NO: 1721 - DNA, 21 bp, Artificial
  Synthethic
gugcccgacaagugcaaguua

SEQ ID NO: 1722 - DNA, 23 bp, Artificial
  Synthethic
uaacuugcacuugucgggcacga

SEQ ID NO: 1723 - DNA, 21 bp, Artificial
  Synthethic
cggauggauguuugugagaca

SEQ ID NO: 1724 - DNA, 23 bp, Artificial
  Synthethic
ugucucacaaacauccauccgcu

SEQ ID NO: 1725 - DNA, 21 bp, Artificial
  Synthethic
accgucgccaaagagacauga

SEQ ID NO: 1726 - DNA, 23 bp, Artificial
  Synthethic
ucaugucucuuuggcgacggugu

SEQ ID NO: 1727 - DNA, 21 bp, Artificial
  Synthethic
gcagcgagaagagcacuaaca

SEQ ID NO: 1728 - DNA, 23 bp, Artificial
  Synthethic
uguuagugcucuucucgcugcau

SEQ ID NO: 1729 - DNA, 21 bp, Artificial
  Synthethic
cagcgagaagagcacuaacua

SEQ ID NO: 1730 - DNA, 23 bp, Artificial
  Synthethic
uaguuagugcucuucucgcugca

SEQ ID NO: 1731 - DNA, 21 bp, Artificial
  Synthethic
gaagagcacuaacuugcacga

SEQ ID NO: 1732 - DNA, 23 bp, Artificial
  Synthethic
ucgugcaaguuagugcucuucuc

SEQ ID NO: 1733 - DNA, 21 bp, Artificial
  Synthethic
aagagcacuaacuugcacgaa

SEQ ID NO: 1734 - DNA, 23 bp, Artificial
  Synthethic
uucgugcaaguuagugcucuucu

SEQ ID NO: 1735 - DNA, 21 bp, Artificial
  Synthethic
agagcacuaacuugcacgaca

SEQ ID NO: 1736 - DNA, 23 bp, Artificial
  Synthethic
ugucgugcaaguuagugcucuuc

SEQ ID NO: 1737 - DNA, 21 bp, Artificial
  Synthethic
agcacuaacuugcacgacuaa

SEQ ID NO: 1738 - DNA, 23 bp, Artificial
  Synthethic
uuagucgugcaaguuagugcucu

SEQ ID NO: 1739 - DNA, 21 bp, Artificial
  Synthethic
gcacuaacuugcacgacuaua

SEQ ID NO: 1740 - DNA, 23 bp, Artificial
  Synthethic
uauagucgugcaaguuagugcuc

SEQ ID NO: 1741 - DNA, 21 bp, Artificial
  Synthethic
cacuaacuugcacgacuauga

SEQ ID NO: 1742 - DNA, 23 bp, Artificial
  Synthethic
ucauagucgugcaaguuagugcu

SEQ ID NO: 1743 - DNA, 21 bp, Artificial
  Synthethic
acuaacuugcacgacuaugga

SEQ ID NO: 1744 - DNA, 23 bp, Artificial
  Synthethic
uccauagucgugcaaguuagugc

SEQ ID NO: 1745 - DNA, 21 bp, Artificial
  Synthethic
uugcacgacuauggcaugcua

SEQ ID NO: 1746 - DNA, 23 bp, Artificial
  Synthethic
uagcaugccauagucgugcaagu

SEQ ID NO: 1747 - DNA, 21 bp, Artificial
  Synthethic
ccgcugguacuuugaugucaa

SEQ ID NO: 1748 - DNA, 23 bp, Artificial
  Synthethic
uugacaucaaaguaccagcggga

SEQ ID NO: 1749 - DNA, 21 bp, Artificial
  Synthethic
gguacuuugaugucacugaaa

SEQ ID NO: 1750 - DNA, 23 bp, Artificial
  Synthethic
uuucagugacaucaaaguaccag

SEQ ID NO: 1751 - DNA, 21 bp, Artificial
  Synthethic
gugugucccauucuuuuacga

SEQ ID NO: 1752 - DNA, 23 bp, Artificial
  Synthethic
ucguaaaagaaugggacacacuu

SEQ ID NO: 1753 - DNA, 21 bp, Artificial
  Synthethic
ugugucccauucuuuuacgga

SEQ ID NO: 1754 - DNA, 23 bp, Artificial
  Synthethic
uccguaaaagaaugggacacacu

SEQ ID NO: 1755 - DNA, 21 bp, Artificial
  Synthethic
gugucccauucuuuuacggca

SEQ ID NO: 1756 - DNA, 23 bp, Artificial
  Synthethic
ugccguaaaagaaugggacacac

SEQ ID NO: 1757 - DNA, 21 bp, Artificial
  Synthethic
ugucccauucuuuuacggcga

SEQ ID NO: 1758 - DNA, 23 bp, Artificial
  Synthethic
ucgccguaaaagaaugggacaca

SEQ ID NO: 1759 - DNA, 21 bp, Artificial
  Synthethic
gucccauucuuuuacggcgga

SEQ ID NO: 1760 - DNA, 23 bp, Artificial
  Synthethic
uccgccguaaaagaaugggacac

SEQ ID NO: 1761 - DNA, 21 bp, Artificial
  Synthethic
gacacggaagaguacugcaua

SEQ ID NO: 1762 - DNA, 23 bp, Artificial
  Synthethic
uaugcaguacucuuccgugucaa

SEQ ID NO: 1763 - DNA, 21 bp, Artificial
  Synthethic
agcgugucaacccaaaguuua

SEQ ID NO: 1764 - DNA, 23 bp, Artificial
  Synthethic
uaaacuuuggguugacacgcugc

SEQ ID NO: 1765 - DNA, 21 bp, Artificial
  Synthethic
gugucaacccaaaguuuacua

SEQ ID NO: 1766 - DNA, 23 bp, Artificial
  Synthethic
uaguaaacuuuggguugacacgc

SEQ ID NO: 1767 - DNA, 21 bp, Artificial
  Synthethic
ugucaacccaaaguuuacuca

SEQ ID NO: 1768 - DNA, 23 bp, Artificial
  Synthethic
ugaguaaacuuuggguugacacg

SEQ ID NO: 1769 - DNA, 21 bp, Artificial
  Synthethic
cccaaaguuuacucaagacua

SEQ ID NO: 1770 - DNA, 23 bp, Artificial
  Synthethic
uagucuugaguaaacuuuggguu

SEQ ID NO: 1771 - DNA, 21 bp, Artificial
  Synthethic
ccaaaguuuacucaagacuaa

SEQ ID NO: 1772 - DNA, 23 bp, Artificial
  Synthethic
uuagucuugaguaaacuuugggu

SEQ ID NO: 1773 - DNA, 21 bp, Artificial
  Synthethic
aaaguuuacucaagacuacca

SEQ ID NO: 1774 - DNA, 23 bp, Artificial
  Synthethic
ugguagucuugaguaaacuuugg

SEQ ID NO: 1775 - DNA, 21 bp, Artificial
  Synthethic
cucaagacuaccagugaacca

SEQ ID NO: 1776 - DNA, 23 bp, Artificial
  Synthethic
ugguucacugguagucuugagua

SEQ ID NO: 1777 - DNA, 21 bp, Artificial
  Synthethic
gacuaccagugaaccucuuca

SEQ ID NO: 1778 - DNA, 23 bp, Artificial
  Synthethic
ugaagagguucacugguagucuu

SEQ ID NO: 1779 - DNA, 21 bp, Artificial
  Synthethic
aagauccugauaaacuuccca

SEQ ID NO: 1780 - DNA, 23 bp, Artificial
  Synthethic
ugggaaguuuaucaggaucuugg

SEQ ID NO: 1781 - DNA, 21 bp, Artificial
  Synthethic
agauccugauaaacuucccaa

SEQ ID NO: 1782 - DNA, 23 bp, Artificial
  Synthethic
uugggaaguuuaucaggaucuug

SEQ ID NO: 1783 - DNA, 21 bp, Artificial
  Synthethic
auccugauaaacuucccacga

SEQ ID NO: 1784 - DNA, 23 bp, Artificial
  Synthethic
ucgugggaaguuuaucaggaucu

SEQ ID NO: 1785 - DNA, 21 bp, Artificial
  Synthethic
uccugauaaacuucccacgaa

SEQ ID NO: 1786 - DNA, 23 bp, Artificial
  Synthethic
uucgugggaaguuuaucaggauc

SEQ ID NO: 1787 - DNA, 21 bp, Artificial
  Synthethic
ccugauaaacuucccacgaca

SEQ ID NO: 1788 - DNA, 23 bp, Artificial
  Synthethic
ugucgugggaaguuuaucaggau

SEQ ID NO: 1789 - DNA, 21 bp, Artificial
  Synthethic
caccgagagagaaugucccaa

SEQ ID NO: 1790 - DNA, 23 bp, Artificial
  Synthethic
uugggacauucucucucggugcu

SEQ ID NO: 1791 - DNA, 21 bp, Artificial
  Synthethic
ucccaggucaugagagaauga

SEQ ID NO: 1792 - DNA, 23 bp, Artificial
  Synthethic
ucauucucucaugaccugggaca

SEQ ID NO: 1793 - DNA, 21 bp, Artificial
  Synthethic
aagcugacaagaaggccguua

SEQ ID NO: 1794 - DNA, 23 bp, Artificial
  Synthethic
uaacggccuucuugucagcuuug

SEQ ID NO: 1795 - DNA, 21 bp, Artificial
  Synthethic
ugacaagaaggccguuaucca

SEQ ID NO: 1796 - DNA, 23 bp, Artificial
  Synthethic
uggauaacggccuucuugucagc

SEQ ID NO: 1797 - DNA, 21 bp, Artificial
  Synthethic
ggcccucgagaauuacaucaa

SEQ ID NO: 1798 - DNA, 23 bp, Artificial
  Synthethic
uugauguaauucucgagggccag

SEQ ID NO: 1799 - DNA, 21 bp, Artificial
  Synthethic
caaggccucaucauguguuca

SEQ ID NO: 1800 - DNA, 23 bp, Artificial
  Synthethic
ugaacacaugaugaggccuuggg

SEQ ID NO: 1801 - DNA, 21 bp, Artificial
  Synthethic
caucauguguucaacaugcua

SEQ ID NO: 1802 - DNA, 23 bp, Artificial
  Synthethic
uagcauguugaacacaugaugag

SEQ ID NO: 1803 - DNA, 21 bp, Artificial
  Synthethic
aacaugcugaagaaguacgua

SEQ ID NO: 1804 - DNA, 23 bp, Artificial
  Synthethic
uacguacuucuucagcauguuga

SEQ ID NO: 1805 - DNA, 21 bp, Artificial
  Synthethic
caugcugaagaaguacgucca

SEQ ID NO: 1806 - DNA, 23 bp, Artificial
  Synthethic
uggacguacuucuucagcauguu

SEQ ID NO: 1807 - DNA, 21 bp, Artificial
  Synthethic
augcugaagaaguacguccga

SEQ ID NO: 1808 - DNA, 23 bp, Artificial
  Synthethic
ucggacguacuucuucagcaugu

SEQ ID NO: 1809 - DNA, 21 bp, Artificial
  Synthethic
ugcugaagaaguacguccgua

SEQ ID NO: 1810 - DNA, 23 bp, Artificial
  Synthethic
uacggacguacuucuucagcaug

SEQ ID NO: 1811 - DNA, 21 bp, Artificial
  Synthethic
gcugaagaaguacguccguga

SEQ ID NO: 1812 - DNA, 23 bp, Artificial
  Synthethic
ucacggacguacuucuucagcau

SEQ ID NO: 1813 - DNA, 21 bp, Artificial
  Synthethic
cugaagaaguacguccgugca

SEQ ID NO: 1814 - DNA, 23 bp, Artificial
  Synthethic
ugcacggacguacuucuucagca

SEQ ID NO: 1815 - DNA, 21 bp, Artificial
  Synthethic
agcacacccuaaagcauuuua

SEQ ID NO: 1816 - DNA, 23 bp, Artificial
  Synthethic
uaaaaugcuuuagggugugcugu

SEQ ID NO: 1817 - DNA, 21 bp, Artificial
  Synthethic
aagcauuuugaacaugugcga

SEQ ID NO: 1818 - DNA, 23 bp, Artificial
  Synthethic
ucgcacauguucaaaaugcuuua

SEQ ID NO: 1819 - DNA, 21 bp, Artificial
  Synthethic
agcauuuugaacaugugcgca

SEQ ID NO: 1820 - DNA, 23 bp, Artificial
  Synthethic
ugcgcacauguucaaaaugcuuu

SEQ ID NO: 1821 - DNA, 21 bp, Artificial
  Synthethic
caccuccgugugaucuacgaa

SEQ ID NO: 1822 - DNA, 23 bp, Artificial
  Synthethic
uucguagaucacacggaggugug

SEQ ID NO: 1823 - DNA, 21 bp, Artificial
  Synthethic
cgugugaucuacgagcgcaua

SEQ ID NO: 1824 - DNA, 23 bp, Artificial
  Synthethic
uaugcgcucguagaucacacgga

SEQ ID NO: 1825 - DNA, 21 bp, Artificial
  Synthethic
ugugaucuacgagcgcaugaa

SEQ ID NO: 1826 - DNA, 23 bp, Artificial
  Synthethic
uucaugcgcucguagaucacacg

SEQ ID NO: 1827 - DNA, 21 bp, Artificial
  Synthethic
gagcgcaugaaccagucucua

SEQ ID NO: 1828 - DNA, 23 bp, Artificial
  Synthethic
uagagacugguucaugcgcucgu

SEQ ID NO: 1829 - DNA, 21 bp, Artificial
  Synthethic
cgcaugaaccagucucuguca

SEQ ID NO: 1830 - DNA, 23 bp, Artificial
  Synthethic
ugacagagacugguucaugcgcu

SEQ ID NO: 1831 - DNA, 21 bp, Artificial
  Synthethic
gaaggagcagaacuacuccga

SEQ ID NO: 1832 - DNA, 23 bp, Artificial
  Synthethic
ucggaguaguucugcuccuucug

SEQ ID NO: 1833 - DNA, 21 bp, Artificial
  Synthethic
aaggagcagaacuacuccgaa

SEQ ID NO: 1834 - DNA, 23 bp, Artificial
  Synthethic
uucggaguaguucugcuccuucu

SEQ ID NO: 1835 - DNA, 21 bp, Artificial
  Synthethic
ggagcagaacuacuccgacga

SEQ ID NO: 1836 - DNA, 23 bp, Artificial
  Synthethic
ucgucggaguaguucugcuccuu

SEQ ID NO: 1837 - DNA, 21 bp, Artificial
  Synthethic
gagcagaacuacuccgacgaa

SEQ ID NO: 1838 - DNA, 23 bp, Artificial
  Synthethic
uucgucggaguaguucugcuccu

SEQ ID NO: 1839 - DNA, 21 bp, Artificial
  Synthethic
cagaauucggacaugauucaa

SEQ ID NO: 1840 - DNA, 23 bp, Artificial
  Synthethic
uugaaucauguccgaauucugca

SEQ ID NO: 1841 - DNA, 21 bp, Artificial
  Synthethic
guccgccaucaaaaacuggua

SEQ ID NO: 1842 - DNA, 23 bp, Artificial
  Synthethic
uaccaguuuuugauggcggacuu

SEQ ID NO: 1843 - DNA, 21 bp, Artificial
  Synthethic
uccgccaucaaaaacugguga

SEQ ID NO: 1844 - DNA, 23 bp, Artificial
  Synthethic
ucaccaguuuuugauggcggacu

SEQ ID NO: 1845 - DNA, 21 bp, Artificial
  Synthethic
cauagcaaccgugauugucaa

SEQ ID NO: 1846 - DNA, 23 bp, Artificial
  Synthethic
uugacaaucacgguugcuaugac

SEQ ID NO: 1847 - DNA, 21 bp, Artificial
  Synthethic
gcaaccgugauugucaucaca

SEQ ID NO: 1848 - DNA, 23 bp, Artificial
  Synthethic
ugugaugacaaucacgguugcua

SEQ ID NO: 1849 - DNA, 21 bp, Artificial
  Synthethic
gaagaaacaguacacauccaa

SEQ ID NO: 1850 - DNA, 23 bp, Artificial
  Synthethic
uuggauguguacuguuucuucuu

SEQ ID NO: 1851 - DNA, 21 bp, Artificial
  Synthethic
gaaacaguacacauccaucca

SEQ ID NO: 1852 - DNA, 23 bp, Artificial
  Synthethic
uggauggauguguacuguuucuu

SEQ ID NO: 1853 - DNA, 21 bp, Artificial
  Synthethic
gcagcagaacggauaugagaa

SEQ ID NO: 1854 - DNA, 23 bp, Artificial
  Synthethic
uucucauauccguucugcugcau

SEQ ID NO: 1855 - DNA, 21 bp, Artificial
  Synthethic
gcagaacggauaugagaauca

SEQ ID NO: 1856 - DNA, 23 bp, Artificial
  Synthethic
ugauucucauauccguucugcug

SEQ ID NO: 1857 - DNA, 21 bp, Artificial
  Synthethic
cagaacggauaugagaaucca

SEQ ID NO: 1858 - DNA, 23 bp, Artificial
  Synthethic
uggauucucauauccguucugcu

SEQ ID NO: 1859 - DNA, 21 bp, Artificial
  Synthethic
agaacggauaugagaauccaa

SEQ ID NO: 1860 - DNA, 23 bp, Artificial
  Synthethic
uuggauucucauauccguucugc

SEQ ID NO: 1861 - DNA, 21 bp, Artificial
  Synthethic
gaacggauaugagaauccaaa

SEQ ID NO: 1862 - DNA, 23 bp, Artificial
  Synthethic
uuuggauucucauauccguucug

SEQ ID NO: 1863 - protein, 6 aa, Homo sapiens
YENPTY

SEQ ID NO: 1864 - protein, 4 aa, Homo sapiens
AICD

SEQ ID NO: 1865 - DNA, 555 bp, Homo sapiens
atgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 1866 - DNA, 555 bp, Homo sapiens
atgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaagatggatgcagaattccgacatgactcaggatatgaagttcatcatcaaaaattggtgttctttgcagaagatgtgggttcaaacaaaggtgcaatcattggactcatagtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 1867 - DNA, 258 bp, Homo sapiens
atgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcgctacgaaaatccaacctacaagttctttgagcagatgcagaactag

SEQ ID NO: 1868 - DNA, 816 bp, Homo sapiens
atgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggagcgccacctgtccaagatgcagcagagcggctacgaaaatccaacctacaagttctttgagcagatgcagaactag

SEQ ID NO: 1869 - DNA, 684 bp, Homo sapiens
atgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttacagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 1870 - DNA, 499 bp, Homo sapiens
atgctgcccggtttggcactgctcctgctggccgcctggacggctcgggcgctggagatacccactgatggtaatgctggcctgctggctgaaccccagattgccatgttctgtggcagactgaacatgcacatgaatgtccagaatgggaagtgggactcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 1871 - DNA, 898 bp, Homo sapiens
atgctgcccggtttggcactgctcctgctggccgcctggacggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggtggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 1872 - DNA, 680 bp, Homo sapiens
atgctgcccggtttggcactgctcctgcagtgggaggagattcaggatgaagttgatgaactgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgtggcagaacggctacgaaaatccaacctacaagttctttgagcagatgcagaactag

SEQ ID NO: 1873 - DNA, 899 bp, Homo sapiens
atgctgcccggtttggcactgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 1874 - DNA, 541 bp, Homo sapiens
atgctgcccggtttggcactgctcctgctggccgcctggacagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 1875 - DNA, 274 bp, Homo sapiens
atgctgcccggtttggcactgctcctgctggccgcctggacggctcgggcgctggaggtacccaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 1876 - DNA, 515 bp, Homo sapiens
atgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtatatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 1877 - DNA, 888 bp, Homo sapiens
atgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 1878 - DNA, 757 bp, Homo sapiens
atgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 1879 - DNA, 1879 bp, Homo sapiens
atgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtacgcgcagaacagaaggacagacagcacaccctaaagcatttcgagcatgtgcgcatggtggatcccaagaaagccgctcagatccggtcccaggttatgacactcctccgtgtgatttatgagcgcatgaatcagtctctctccctgctctacaacgtgcctgcagtggccgaggagattcaggatgaagttggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 1880 - DNA, 144 bp, Homo sapiens
atgctgcccggtttggcactgctcctgctggccgcctggacggctcgggcgctggaggtacccactgatggtaatgctggcctgctggctgaaccccagattgccatgttctgtggcagaaagttctttgagcagatgcagaac

SEQ ID NO: 1881 - DNA, 23 bp, Artificial
  Synthethic
ugaacutguagguuggauuuucg

SEQ ID NO: 1882 - DNA, 23 bp, Artificial
  Synthethic
ugaacutguagguuggauuuucg

SEQ ID NO: 1883 - DNA, 21 bp, Artificial
  Synthethic
aaagagcaaaacuauucagau

SEQ ID NO: 1884 - DNA, 23 bp, Artificial
  Synthethic
aucugaauaguuuugcucuuucu

SEQ ID NO: 1885 - DNA, 23 bp, Artificial
  Synthethic
agaaagagcaaaacuauucagau

SEQ ID NO: 1886 - DNA, 21 bp, Artificial
  Synthethic
uuggccaacaugauuagugau

SEQ ID NO: 1887 - DNA, 23 bp, Artificial
  Synthethic
aucacuaaucauguuggccaaga

SEQ ID NO: 1888 - DNA, 23 bp, Artificial
  Synthethic
ucuuggccaacaugauuagugaa

SEQ ID NO: 1889 - DNA, 21 bp, Artificial
  Synthethic
ucuggguugacaaauaucaau

SEQ ID NO: 1890 - DNA, 23 bp, Artificial
  Synthethic
auugauauuugucaacccagaac

SEQ ID NO: 1891 - DNA, 23 bp, Artificial
  Synthethic
guucuggguugacaaauaucaag

SEQ ID NO: 1892 - DNA, 21 bp, Artificial
  Synthethic
uuuaugauuuacucauuaucu

SEQ ID NO: 1893 - DNA, 23 bp, Artificial
  Synthethic
agauaaugaguaaaucauaaaac

SEQ ID NO: 1894 - DNA, 23 bp, Artificial
  Synthethic
guuuuaugauuuacucauuaucg

SEQ ID NO: 1895 - DNA, 21 bp, Artificial
  Synthethic
augccugaacuugaauuaauu

SEQ ID NO: 1896 - DNA, 23 bp, Artificial
  Synthethic
aauuaauucaaguucaggcaucu

SEQ ID NO: 1897 - DNA, 23 bp, Artificial
  Synthethic
agaugccugaacuugaauuaauc

SEQ ID NO: 1898 - DNA, 21 bp, Artificial
  Synthethic
agaugccugaacuugaauuau

SEQ ID NO: 1899 - DNA, 23 bp, Artificial
  Synthethic
auaauucaaguucaggcaucuac

SEQ ID NO: 1900 - DNA, 23 bp, Artificial
  Synthethic
guagaugccugaacuugaauuaa

SEQ ID NO: 1901 - DNA, 21 bp, Artificial
  Synthethic
gccugaacuugaauuaauccu

SEQ ID NO: 1902 - DNA, 23 bp, Artificial
  Synthethic
aggauuaauucaaguucaggcau

SEQ ID NO: 1903 - DNA, 23 bp, Artificial
  Synthethic
augccugaacuugaauuaaucca

SEQ ID NO: 1904 - DNA, 21 bp, Artificial
  Synthethic
gugguuugugacccaauuaau

SEQ ID NO: 1905 - DNA, 23 bp, Artificial
  Synthethic
auuaauugggucacaaaccacaa

SEQ ID NO: 1906 - DNA, 23 bp, Artificial
  Synthethic
uugugguuugugacccaauuaag

SEQ ID NO: 1907 - DNA, 21 bp, Artificial
  Synthethic
cagaugcuuuagagagauuuu

SEQ ID NO: 1908 - DNA, 23 bp, Artificial
  Synthethic
aaaaucucucuaaagcaucugaa

SEQ ID NO: 1909 - DNA, 23 bp, Artificial
  Synthethic
uucagaugcuuuagagagauuuu

SEQ ID NO: 1910 - DNA, 21 bp, Artificial
  Synthethic
ucuugccuaaguauuccuuuu

SEQ ID NO: 1911 - DNA, 23 bp, Artificial
  Synthethic
aaaaggaauacuuaggcaagaga

SEQ ID NO: 1912 - DNA, 23 bp, Artificial
  Synthethic
ucucuugccuaaguauuccuuuc

SEQ ID NO: 1913 - DNA, 21 bp, Artificial
  Synthethic
uugcugcuucugcuauauuuu

SEQ ID NO: 1914 - DNA, 23 bp, Artificial
  Synthethic
aaaauauagcagaagcagcaauc

SEQ ID NO: 1915 - DNA, 23 bp, Artificial
  Synthethic
gauugcugcuucugcuauauuug

SEQ ID NO: 1916 - DNA, 21 bp, Artificial
  Synthethic
aaagagcaaaacuauucagau

SEQ ID NO: 1917 - DNA, 23 bp, Artificial
  Synthethic
aucugaauaguuuugcucuuucu

SEQ ID NO: 1918 - DNA, 21 bp, Artificial
  Synthethic
uuggccaacaugauuagugau

SEQ ID NO: 1919 - DNA, 23 bp, Artificial
  Synthethic
aucacuaaucauguuggccaaga

SEQ ID NO: 1920 - DNA, 21 bp, Artificial
  Synthethic
ucuggguugacaaauaucaau

SEQ ID NO: 1921 - DNA, 23 bp, Artificial
  Synthethic
auugauauuugucaacccagaac

SEQ ID NO: 1922 - DNA, 21 bp, Artificial
  Synthethic
uuuaugauuuacucauuaucu

SEQ ID NO: 1923 - DNA, 23 bp, Artificial
  Synthethic
agauaaugaguaaaucauaaaac

SEQ ID NO: 1924 - DNA, 21 bp, Artificial
  Synthethic
augccugaacuugaauuaauu

SEQ ID NO: 1925 - DNA, 23 bp, Artificial
  Synthethic
aauuaauucaaguucaggcaucu

SEQ ID NO: 1926 - DNA, 21 bp, Artificial
  Synthethic
agaugccugaacuugaauuau

SEQ ID NO: 1927 - DNA, 23 bp, Artificial
  Synthethic
auaauucaaguucaggcaucuac

SEQ ID NO: 1928 - DNA, 21 bp, Artificial
  Synthethic
gccugaacuugaauuaauccu

SEQ ID NO: 1929 - DNA, 23 bp, Artificial
  Synthethic
aggauuaauucaaguucaggcau

SEQ ID NO: 1930 - DNA, 21 bp, Artificial
  Synthethic
gugguuugugacccaauuaau

SEQ ID NO: 1931 - DNA, 23 bp, Artificial
  Synthethic
auuaauugggucacaaaccacaa

SEQ ID NO: 1932 - DNA, 21 bp, Artificial
  Synthethic
cagaugcuuuagagagauuuu

SEQ ID NO: 1933 - DNA, 23 bp, Artificial
  Synthethic
aaaaucucucuaaagcaucugaa

SEQ ID NO: 1934 - DNA, 21 bp, Artificial
  Synthethic
ucuugccuaaguauuccuuuu

SEQ ID NO: 1935 - DNA, 23 bp, Artificial
  Synthethic
aaaaggaauacuuaggcaagaga

SEQ ID NO: 1936 - DNA, 21 bp, Artificial
  Synthethic
uugcugcuucugcuauauuuu

SEQ ID NO: 1937 - DNA, 23 bp, Artificial
  Synthethic
aaaauauagcagaagcagcaauc

SEQ ID NO: 1938 - DNA, 21 bp, Artificial
  Synthethic
cgcuuucuacacuguauuaca

SEQ ID NO: 1939 - DNA, 23 bp, Artificial
  Synthethic
uguaauacaguguagaaagcgau

SEQ ID NO: 1940 - DNA, 21 bp, Artificial
  Synthethic
gcuuucuacacuguauuacaa

SEQ ID NO: 1941 - DNA, 23 bp, Artificial
  Synthethic
uuguaauacaguguagaaagcga

SEQ ID NO: 1942 - DNA, 21 bp, Artificial
  Synthethic
uucuacacuguauuacauaaa

SEQ ID NO: 1943 - DNA, 23 bp, Artificial
  Synthethic
uuuauguaauacaguguagaaag

SEQ ID NO: 1944 - DNA, 21 bp, Artificial
  Synthethic
uuucuacacuguauuacauaa

SEQ ID NO: 1945 - DNA, 23 bp, Artificial
  Synthethic
uuauguaauacaguguagaaagc

SEQ ID NO: 1946 - DNA, 21 bp, Artificial
  Synthethic
auuuagcuguaucaaacuaga

SEQ ID NO: 1947 - DNA, 23 bp, Artificial
  Synthethic
ucuaguuugauacagcuaaauuc

SEQ ID NO: 1948 - DNA, 21 bp, Artificial
  Synthethic
uuccugaucacuaugcauuua

SEQ ID NO: 1949 - DNA, 23 bp, Artificial
  Synthethic
uaaaugcauagugaucaggaaag

SEQ ID NO: 1950 - DNA, 21 bp, Artificial
  Synthethic
gugcuguaacacaaguagaua

SEQ ID NO: 1951 - DNA, 23 bp, Artificial
  Synthethic
uaucuacuuguguuacagcacag

SEQ ID NO: 1952 - DNA, 21 bp, Artificial
  Synthethic
uuuagcuguaucaaacuagua

SEQ ID NO: 1953 - DNA, 23 bp, Artificial
  Synthethic
uacuaguuugauacagcuaaauu

SEQ ID NO: 1954 - DNA, 21 bp, Artificial
  Synthethic
uuuccugaucacuaugcauua

SEQ ID NO: 1955 - DNA, 23 bp, Artificial
  Synthethic
uaaugcauagugaucaggaaagg

SEQ ID NO: 1956 - DNA, 21 bp, Artificial
  Synthethic
aauggguuuuguguacuguaa

SEQ ID NO: 1957 - DNA, 23 bp, Artificial
  Synthethic
uuacaguacacaaaacccauuaa

SEQ ID NO: 1958 - DNA, 21 bp, Artificial
  Synthethic
auuguacagaaucauugcuua

SEQ ID NO: 1959 - DNA, 23 bp, Artificial
  Synthethic
uaagcaaugauucuguacaauca

SEQ ID NO: 1960 - DNA, 21 bp, Artificial
  Synthethic
uuguacagaaucauugcuuaa

SEQ ID NO: 1961 - DNA, 23 bp, Artificial
  Synthethic
uuaagcaaugauucuguacaauc

SEQ ID NO: 1962 - DNA, 21 bp, Artificial
  Synthethic
uuacuguacagauugcugcua

SEQ ID NO: 1963 - DNA, 23 bp, Artificial
  Synthethic
uagcagcaaucuguacaguaaaa

SEQ ID NO: 1964 - DNA, 21 bp, Artificial
  Synthethic
auaugcugaagaaguacguca

SEQ ID NO: 1965 - DNA, 23 bp, Artificial
  Synthethic
ugacguacuucuucagcauauug

SEQ ID NO: 1966 - DNA, 21 bp, Artificial
  Synthethic
accauugcuucacuacccaua

SEQ ID NO: 1967 - DNA, 23 bp, Artificial
  Synthethic
uauggguagugaagcaaugguuu

SEQ ID NO: 1968 - DNA, 21 bp, Artificial
  Synthethic
cugugcuguaacacaaguaga

SEQ ID NO: 1969 - DNA, 23 bp, Artificial
  Synthethic
ucuacuuguguuacagcacagcu

SEQ ID NO: 1970 - DNA, 21 bp, Artificial
  Synthethic
ugcuguaacacaaguagauga

SEQ ID NO: 1971 - DNA, 23 bp, Artificial
  Synthethic
ucaucuacuuguguuacagcaca

SEQ ID NO: 1972 - DNA, 21 bp, Artificial
  Synthethic
acagcugugcuguaacacaaa

SEQ ID NO: 1973 - DNA, 23 bp, Artificial
  Synthethic
uuuguguuacagcacagcuguca

SEQ ID NO: 1974 - DNA, 21 bp, Artificial
  Synthethic
gcuguaacacaaguagaugca

SEQ ID NO: 1975 - DNA, 23 bp, Artificial
  Synthethic
ugcaucuacuuguguuacagcac

SEQ ID NO: 1976 - DNA, 21 bp, Artificial
  Synthethic
ucaaacuagugcaugaauaga

SEQ ID NO: 1977 - DNA, 23 bp, Artificial
  Synthethic
ucuauucaugcacuaguuugaua

SEQ ID NO: 1978 - DNA, 21 bp, Artificial
  Synthethic
caaacuagugcaugaauagaa

SEQ ID NO: 1979 - DNA, 23 bp, Artificial
  Synthethic
uucuauucaugcacuaguuugau

SEQ ID NO: 1980 - DNA, 21 bp, Artificial
  Synthethic
ugcaggaugauuguacagaaa

SEQ ID NO: 1981 - DNA, 23 bp, Artificial
  Synthethic
uuucuguacaaucauccugcaga

SEQ ID NO: 1982 - DNA, 21 bp, Artificial
  Synthethic
gcaggaugauuguacagaaua

SEQ ID NO: 1983 - DNA, 23 bp, Artificial
  Synthethic
uauucuguacaaucauccugcag

SEQ ID NO: 1984 - DNA, 21 bp, Artificial
  Synthethic
caggaugauuguacagaauca

SEQ ID NO: 1985 - DNA, 23 bp, Artificial
  Synthethic
ugauucuguacaaucauccugca

SEQ ID NO: 1986 - DNA, 21 bp, Artificial
  Synthethic
uaucaaacuagugcaugaaua

SEQ ID NO: 1987 - DNA, 23 bp, Artificial
  Synthethic
uauucaugcacuaguuugauaca

SEQ ID NO: 1988 - DNA, 21 bp, Artificial
  Synthethic
uuugugccuguuuuaugugca

SEQ ID NO: 1989 - DNA, 23 bp, Artificial
  Synthethic
ugcacauaaaacaggcacaaaga

SEQ ID NO: 1990 - DNA, 21 bp, Artificial
  Synthethic
uugugccuguuuuaugugcaa

SEQ ID NO: 1991 - DNA, 23 bp, Artificial
  Synthethic
uugcacauaaaacaggcacaaag

SEQ ID NO: 1992 - DNA, 21 bp, Artificial
  Synthethic
cugcaggaugauuguacagaa

SEQ ID NO: 1993 - DNA, 23 bp, Artificial
  Synthethic
uucuguacaaucauccugcagaa

SEQ ID NO: 1994 - DNA, 21 bp, Artificial
  Synthethic
caggucaugagagaaugggaa

SEQ ID NO: 1995 - DNA, 23 bp, Artificial
  Synthethic
uucccauucucucaugaccuggg

SEQ ID NO: 1996 - DNA, 21 bp, Artificial
  Synthethic
uaugugcacacauuaggcaua

SEQ ID NO: 1997 - DNA, 23 bp, Artificial
  Synthethic
uaugccuaaugugugcacauaaa

SEQ ID NO: 1998 - DNA, 21 bp, Artificial
  Synthethic
ugugcacacauuaggcauuga

SEQ ID NO: 1999 - DNA, 23 bp, Artificial
  Synthethic
ucaaugccuaaugugugcacaua

SEQ ID NO: 2000 - DNA, 21 bp, Artificial
  Synthethic
ggaugauuguacagaaucaua

SEQ ID NO: 2001 - DNA, 23 bp, Artificial
  Synthethic
uaugauucuguacaaucauccug

SEQ ID NO: 2002 - DNA, 21 bp, Artificial
  Synthethic
accauccagaacuggugcaaa

SEQ ID NO: 2003 - DNA, 23 bp, Artificial
  Synthethic
uuugcaccaguucuggaugguca

SEQ ID NO: 2004 - DNA, 21 bp, Artificial
  Synthethic
uaugcugaagaaguacgucca

SEQ ID NO: 2005 - DNA, 23 bp, Artificial
  Synthethic
uggacguacuucuucagcauauu

SEQ ID NO: 2006 - DNA, 21 bp, Artificial
  Synthethic
augcugaagaaguacguccga

SEQ ID NO: 2007 - DNA, 23 bp, Artificial
  Synthethic
ucggacguacuucuucagcauau

SEQ ID NO: 2008 - DNA, 21 bp, Artificial
  Synthethic
aaaccauugcuucacuaccca

SEQ ID NO: 2009 - DNA, 23 bp, Artificial
  Synthethic
uggguagugaagcaaugguuuug

SEQ ID NO: 2010 - DNA, 21 bp, Artificial
  Synthethic
aaccauugcuucacuacccaa

SEQ ID NO: 2011 - DNA, 23 bp, Artificial
  Synthethic
uuggguagugaagcaaugguuuu

SEQ ID NO: 2012 - DNA, 21 bp, Artificial
  Synthethic
caccgagagagaaugucccaa

SEQ ID NO: 2013 - DNA, 23 bp, Artificial
  Synthethic
uugggacauucucucucggugcu

SEQ ID NO: 2014 - DNA, 21 bp, Artificial
  Synthethic
guuguauauuauucuugugga

SEQ ID NO: 2015 - DNA, 23 bp, Artificial
  Synthethic
uccacaagaauaauauacaacug

SEQ ID NO: 2016 - DNA, 21 bp, Artificial
  Synthethic
uuaugugcacacauuaggcaa

SEQ ID NO: 2017 - DNA, 23 bp, Artificial
  Synthethic
uugccuaaugugugcacauaaaa

SEQ ID NO: 2018 - DNA, 21 bp, Artificial
  Synthethic
augugcacacauuaggcauua

SEQ ID NO: 2019 - DNA, 23 bp, Artificial
  Synthethic
uaaugccuaaugugugcacauaa

SEQ ID NO: 2020 - DNA, 21 bp, Artificial
  Synthethic
gugcacacauuaggcauugaa

SEQ ID NO: 2021 - DNA, 23 bp, Artificial
  Synthethic
uucaaugccuaaugugugcacau

SEQ ID NO: 2022 - DNA, 21 bp, Artificial
  Synthethic
ugauuguacagaaucauugca

SEQ ID NO: 2023 - DNA, 23 bp, Artificial
  Synthethic
ugcaaugauucuguacaaucauc

SEQ ID NO: 2024 - DNA, 21 bp, Artificial
  Synthethic
gcuucacuacccaucggugua

SEQ ID NO: 2025 - DNA, 23 bp, Artificial
  Synthethic
uacaccgauggguagugaagcaa

SEQ ID NO: 2026 - DNA, 21 bp, Artificial
  Synthethic
uuuuaugugcacacauuagga

SEQ ID NO: 2027 - DNA, 23 bp, Artificial
  Synthethic
uccuaaugugugcacauaaaaca

SEQ ID NO: 2028 - DNA, 21 bp, Artificial
  Synthethic
cgcuuucuacacuguauuaca

SEQ ID NO: 2029 - DNA, 23 bp, Artificial
  Synthethic
uguaauacaguguagaaagcgau

SEQ ID NO: 2030 - DNA, 21 bp, Artificial
  Synthethic
gcuuucuacacuguauuacaa

SEQ ID NO: 2031 - DNA, 23 bp, Artificial
  Synthethic
uuguaatacaguguagaaagcga

SEQ ID NO: 2032 - DNA, 21 bp, Artificial
  Synthethic
uucuacacuguauuacauaaa

SEQ ID NO: 2033 - DNA, 23 bp, Artificial
  Synthethic
uuuaugtaauacaguguagaaag

SEQ ID NO: 2034 - DNA, 21 bp, Artificial
  Synthethic
uuucuacacuguauuacauaa

SEQ ID NO: 2035 - DNA, 23 bp, Artificial
  Synthethic
uuauguaauacaguguagaaagc

SEQ ID NO: 2036 - DNA, 21 bp, Artificial
  Synthethic
auuuagcuguaucaaacuaga

SEQ ID NO: 2037 - DNA, 23 bp, Artificial
  Synthethic
ucuagutugauacagcuaaauuc

SEQ ID NO: 2038 - DNA, 21 bp, Artificial
  Synthethic
uuccugaucacuaugcauuua

SEQ ID NO: 2039 - DNA, 23 bp, Artificial
  Synthethic
uaaaugcauagugaucaggaaag

SEQ ID NO: 2040 - DNA, 21 bp, Artificial
  Synthethic
gugcuguaacacaaguagaua

SEQ ID NO: 2041 - DNA, 23 bp, Artificial
  Synthethic
uaucuacuuguguuacagcacag

SEQ ID NO: 2042 - DNA, 21 bp, Artificial
  Synthethic
uuuagcuguaucaaacuagua

SEQ ID NO: 2043 - DNA, 23 bp, Artificial
  Synthethic
uacuagtuugauacagcuaaauu

SEQ ID NO: 2044 - DNA, 21 bp, Artificial
  Synthethic
uuuccugaucacuaugcauua

SEQ ID NO: 2045 - DNA, 23 bp, Artificial
  Synthethic
uaaugcauagugaucaggaaagg

SEQ ID NO: 2046 - DNA, 21 bp, Artificial
  Synthethic
aauggguuuuguguacuguaa

SEQ ID NO: 2047 - DNA, 23 bp, Artificial
  Synthethic
uuacagtacacaaaacccauuaa

SEQ ID NO: 2048 - DNA, 21 bp, Artificial
  Synthethic
uuacuguacagauugcugcua

SEQ ID NO: 2049 - DNA, 23 bp, Artificial
  Synthethic
uagcagcaaucuguacaguaaaa

SEQ ID NO: 2050 - DNA, 21 bp, Artificial
  Synthethic
auuguacagaaucauugcuua

SEQ ID NO: 2051 - DNA, 23 bp, Artificial
  Synthethic
uaagcaaugauucuguacaauca

SEQ ID NO: 2052 - DNA, 21 bp, Artificial
  Synthethic
uuguacagaaucauugcuuaa

SEQ ID NO: 2053 - DNA, 23 bp, Artificial
  Synthethic
uuaagcaaugauucuguacaauc

SEQ ID NO: 2054 - DNA, 21 bp, Artificial
  Synthethic
auaugcugaagaaguacguca

SEQ ID NO: 2055 - DNA, 23 bp, Artificial
  Synthethic
ugacguacuucuucagcauauug

SEQ ID NO: 2056 - DNA, 21 bp, Artificial
  Synthethic
accauugcuucacuacccaua

SEQ ID NO: 2057 - DNA, 23 bp, Artificial
  Synthethic
uaugggtagugaagcaaugguuu

SEQ ID NO: 2058 - DNA, 21 bp, Artificial
  Synthethic
cugugcuguaacacaaguaga

SEQ ID NO: 2059 - DNA, 23 bp, Artificial
  Synthethic
ucuacutguguuacagcacagcu

SEQ ID NO: 2060 - DNA, 21 bp, Artificial
  Synthethic
ugcuguaacacaaguagauga

SEQ ID NO: 2061 - DNA, 23 bp, Artificial
  Synthethic
ucaucuacuuguguuacagcaca

SEQ ID NO: 2062 - DNA, 21 bp, Artificial
  Synthethic
acagcugugcuguaacacaaa

SEQ ID NO: 2063 - DNA, 23 bp, Artificial
  Synthethic
uuugugtuacagcacagcuguca

SEQ ID NO: 2064 - DNA, 21 bp, Artificial
  Synthethic
gcuguaacacaaguagaugca

SEQ ID NO: 2065 - DNA, 23 bp, Artificial
  Synthethic
ugcauctacuuguguuacagcac

SEQ ID NO: 2066 - DNA, 21 bp, Artificial
  Synthethic
ucaaacuagugcaugaauaga

SEQ ID NO: 2067 - DNA, 23 bp, Artificial
  Synthethic
ucuauucaugcacuaguuugaua

SEQ ID NO: 2068 - DNA, 21 bp, Artificial
  Synthethic
caaacuagugcaugaauagaa

SEQ ID NO: 2069 - DNA, 23 bp, Artificial
  Synthethic
uucuautcaugcacuaguuugau

SEQ ID NO: 2070 - DNA, 21 bp, Artificial
  Synthethic
ugcaggaugauuguacagaaa

SEQ ID NO: 2071 - DNA, 23 bp, Artificial
  Synthethic
uuucugtacaaucauccugcaga

SEQ ID NO: 2072 - DNA, 21 bp, Artificial
  Synthethic
gcaggaugauuguacagaaua

SEQ ID NO: 2073 - DNA, 23 bp, Artificial
  Synthethic
uauucuguacaaucauccugcag

SEQ ID NO: 2074 - DNA, 21 bp, Artificial
  Synthethic
caggaugauuguacagaauca

SEQ ID NO: 2075 - DNA, 23 bp, Artificial
  Synthethic
ugauuctguacaaucauccugca

SEQ ID NO: 2076 - DNA, 21 bp, Artificial
  Synthethic
uaucaaacuagugcaugaaua

SEQ ID NO: 2077 - DNA, 23 bp, Artificial
  Synthethic
uauucatgcacuaguuugauaca

SEQ ID NO: 2078 - DNA, 21 bp, Artificial
  Synthethic
uuugugccuguuuuaugugca

SEQ ID NO: 2079 - DNA, 23 bp, Artificial
  Synthethic
ugcacataaaacaggcacaaaga

SEQ ID NO: 2080 - DNA, 21 bp, Artificial
  Synthethic
uugugccuguuuuaugugcaa

SEQ ID NO: 2081 - DNA, 23 bp, Artificial
  Synthethic
uugcacauaaaacaggcacaaag

SEQ ID NO: 2082 - DNA, 21 bp, Artificial
  Synthethic
cugcaggaugauuguacagaa

SEQ ID NO: 2083 - DNA, 23 bp, Artificial
  Synthethic
uucuguacaaucauccugcagaa

SEQ ID NO: 2084 - DNA, 21 bp, Artificial
  Synthethic
caggucaugagagaaugggaa

SEQ ID NO: 2085 - DNA, 23 bp, Artificial
  Synthethic
uucccatucucucaugaccuggg

SEQ ID NO: 2086 - DNA, 21 bp, Artificial
  Synthethic
uaugcugaagaaguacgucca

SEQ ID NO: 2087 - DNA, 23 bp, Artificial
  Synthethic
uggacgtacuucuucagcauauu

SEQ ID NO: 2088 - DNA, 21 bp, Artificial
  Synthethic
augcugaagaaguacguccga

SEQ ID NO: 2089 - DNA, 23 bp, Artificial
  Synthethic
ucggacguacuucuucagcauau

SEQ ID NO: 2090 - DNA, 21 bp, Artificial
  Synthethic
aaaccauugcuucacuaccca

SEQ ID NO: 2091 - DNA, 23 bp, Artificial
  Synthethic
uggguagugaagcaaugguuuug

SEQ ID NO: 2092 - DNA, 21 bp, Artificial
  Synthethic
aaccauugcuucacuacccaa

SEQ ID NO: 2093 - DNA, 23 bp, Artificial
  Synthethic
uuggguagugaagcaaugguuuu

SEQ ID NO: 2094 - DNA, 21 bp, Artificial
  Synthethic
uaugugcacacauuaggcaua

SEQ ID NO: 2095 - DNA, 23 bp, Artificial
  Synthethic
uaugcctaaugugugcacauaaa

SEQ ID NO: 2096 - DNA, 21 bp, Artificial
  Synthethic
ugugcacacauuaggcauuga

SEQ ID NO: 2097 - DNA, 23 bp, Artificial
  Synthethic
ucaaugccuaaugugugcacaua

SEQ ID NO: 2098 - DNA, 21 bp, Artificial
  Synthethic
ggaugauuguacagaaucaua

SEQ ID NO: 2099 - DNA, 23 bp, Artificial
  Synthethic
uaugautcuguacaaucauccug

SEQ ID NO: 2100 - DNA, 21 bp, Artificial
  Synthethic
accauccagaacuggugcaaa

SEQ ID NO: 2101 - DNA, 23 bp, Artificial
  Synthethic
uuugcaccaguucuggaugguca

SEQ ID NO: 2102 - DNA, 21 bp, Artificial
  Synthethic
caccgagagagaaugucccaa

SEQ ID NO: 2103 - DNA, 23 bp, Artificial
  Synthethic
uugggacauucucucucggugcu

SEQ ID NO: 2104 - DNA, 21 bp, Artificial
  Synthethic
guuguauauuauucuugugga

SEQ ID NO: 2105 - DNA, 23 bp, Artificial
  Synthethic
uccacaagaauaauauacaacug

SEQ ID NO: 2106 - DNA, 21 bp, Artificial
  Synthethic
uuaugugcacacauuaggcaa

SEQ ID NO: 2107 - DNA, 23 bp, Artificial
  Synthethic
uugccuaaugugugcacauaaaa

SEQ ID NO: 2108 - DNA, 21 bp, Artificial
  Synthethic
augugcacacauuaggcauua

SEQ ID NO: 2109 - DNA, 23 bp, Artificial
  Synthethic
uaaugccuaaugugugcacauaa

SEQ ID NO: 2110 - DNA, 21 bp, Artificial
  Synthethic
gugcacacauuaggcauugaa

SEQ ID NO: 2111 - DNA, 23 bp, Artificial
  Synthethic
uucaaugccuaaugugugcacau

SEQ ID NO: 2112 - DNA, 21 bp, Artificial
  Synthethic
ugauuguacagaaucauugca

SEQ ID NO: 2113 - DNA, 23 bp, Artificial
  Synthethic
ugcaaugauucuguacaaucauc

SEQ ID NO: 2114 - DNA, 21 bp, Artificial
  Synthethic
gcuucacuacccaucggugua

SEQ ID NO: 2115 - DNA, 23 bp, Artificial
  Synthethic
uacaccgauggguagugaagcaa

SEQ ID NO: 2116 - DNA, 21 bp, Artificial
  Synthethic
uuuuaugugcacacauuagga

SEQ ID NO: 2117 - DNA, 23 bp, Artificial
  Synthethic
uccuaatgugugcacauaaaaca

SEQ ID NO: 2118 - DNA, 21 bp, Artificial
  Synthethic
cgcuuucuacacuguauuaca

SEQ ID NO: 2119 - DNA, 23 bp, Artificial
  Synthethic
uguaauacaguguagaaagcgau

SEQ ID NO: 2120 - DNA, 21 bp, Artificial
  Synthethic
gcuuucuacacuguauuacaa

SEQ ID NO: 2121 - DNA, 23 bp, Artificial
  Synthethic
uuguaauacaguguagaaagcga

SEQ ID NO: 2122 - DNA, 21 bp, Artificial
  Synthethic
uucuacacuguauuacauaaa

SEQ ID NO: 2123 - DNA, 23 bp, Artificial
  Synthethic
uuuauguaauacaguguagaaag

SEQ ID NO: 2124 - DNA, 21 bp, Artificial
  Synthethic
uuucuacacuguauuacauaa

SEQ ID NO: 2125 - DNA, 23 bp, Artificial
  Synthethic
uuauguaauacaguguagaaagc

SEQ ID NO: 2126 - DNA, 21 bp, Artificial
  Synthethic
auuuagcuguaucaaacuaga

SEQ ID NO: 2127 - DNA, 23 bp, Artificial
  Synthethic
ucuaguuugauacagcuaaauuc

SEQ ID NO: 2128 - DNA, 21 bp, Artificial
  Synthethic
uuccugaucacuaugcauuua

SEQ ID NO: 2129 - DNA, 23 bp, Artificial
  Synthethic
uaaaugcauagugaucaggaaag

SEQ ID NO: 2130 - DNA, 21 bp, Artificial
  Synthethic
gugcuguaacacaaguagaua

SEQ ID NO: 2131 - DNA, 23 bp, Artificial
  Synthethic
uaucuacuuguguuacagcacag

SEQ ID NO: 2132 - DNA, 21 bp, Artificial
  Synthethic
uuuagcuguaucaaacuagua

SEQ ID NO: 2133 - DNA, 23 bp, Artificial
  Synthethic
uacuaguuugauacagcuaaauu

SEQ ID NO: 2134 - DNA, 21 bp, Artificial
  Synthethic
uuuccugaucacuaugcauua

SEQ ID NO: 2135 - DNA, 23 bp, Artificial
  Synthethic
uaaugcauagugaucaggaaagg

SEQ ID NO: 2136 - DNA, 21 bp, Artificial
  Synthethic
aauggguuuuguguacuguaa

SEQ ID NO: 2137 - DNA, 23 bp, Artificial
  Synthethic
uuacaguacacaaaacccauuaa

SEQ ID NO: 2138 - DNA, 21 bp, Artificial
  Synthethic
auuguacagaaucauugcuua

SEQ ID NO: 2139 - DNA, 23 bp, Artificial
  Synthethic
uaagcaaugauucuguacaauca

SEQ ID NO: 2140 - DNA, 21 bp, Artificial
  Synthethic
uuguacagaaucauugcuuaa

SEQ ID NO: 2141 - DNA, 23 bp, Artificial
  Synthethic
uuaagcaaugauucuguacaauc

SEQ ID NO: 2142 - DNA, 21 bp, Artificial
  Synthethic
uuacuguacagauugcugcua

SEQ ID NO: 2143 - DNA, 23 bp, Artificial
  Synthethic
uagcagcaaucuguacaguaaaa

SEQ ID NO: 2144 - DNA, 21 bp, Artificial
  Synthethic
auaugcugaagaaguacguca

SEQ ID NO: 2145 - DNA, 23 bp, Artificial
  Synthethic
ugacguacuucuucagcauauug

SEQ ID NO: 2146 - DNA, 21 bp, Artificial
  Synthethic
accauugcuucacuacccaua

SEQ ID NO: 2147 - DNA, 23 bp, Artificial
  Synthethic
uauggguagugaagcaaugguuu

SEQ ID NO: 2148 - DNA, 21 bp, Artificial
  Synthethic
cugugcuguaacacaaguaga

SEQ ID NO: 2149 - DNA, 23 bp, Artificial
  Synthethic
ucuacuuguguuacagcacagcu

SEQ ID NO: 2150 - DNA, 21 bp, Artificial
  Synthethic
ugcuguaacacaaguagauga

SEQ ID NO: 2151 - DNA, 23 bp, Artificial
  Synthethic
ucaucuacuuguguuacagcaca

SEQ ID NO: 2152 - DNA, 21 bp, Artificial
  Synthethic
acagcugugcuguaacacaaa

SEQ ID NO: 2153 - DNA, 23 bp, Artificial
  Synthethic
uuuguguuacagcacagcuguca

SEQ ID NO: 2154 - DNA, 21 bp, Artificial
  Synthethic
gcuguaacacaaguagaugca

SEQ ID NO: 2155 - DNA, 23 bp, Artificial
  Synthethic
ugcaucuacuuguguuacagcac

SEQ ID NO: 2156 - DNA, 21 bp, Artificial
  Synthethic
ucaaacuagugcaugaauaga

SEQ ID NO: 2157 - DNA, 23 bp, Artificial
  Synthethic
ucuauucaugcacuaguuugaua

SEQ ID NO: 2158 - DNA, 21 bp, Artificial
  Synthethic
caaacuagugcaugaauagaa

SEQ ID NO: 2159 - DNA, 23 bp, Artificial
  Synthethic
uucuauucaugcacuaguuugau

SEQ ID NO: 2160 - DNA, 21 bp, Artificial
  Synthethic
ugcaggaugauuguacagaaa

SEQ ID NO: 2161 - DNA, 23 bp, Artificial
  Synthethic
uuucuguacaaucauccugcaga

SEQ ID NO: 2162 - DNA, 21 bp, Artificial
  Synthethic
gcaggaugauuguacagaaua

SEQ ID NO: 2163 - DNA, 23 bp, Artificial
  Synthethic
uauucuguacaaucauccugcag

SEQ ID NO: 2164 - DNA, 21 bp, Artificial
  Synthethic
caggaugauuguacagaauca

SEQ ID NO: 2165 - DNA, 23 bp, Artificial
  Synthethic
ugauucuguacaaucauccugca

SEQ ID NO: 2166 - DNA, 21 bp, Artificial
  Synthethic
uaucaaacuagugcaugaaua

SEQ ID NO: 2167 - DNA, 23 bp, Artificial
  Synthethic
uauucaugcacuaguuugauaca

SEQ ID NO: 2168 - DNA, 21 bp, Artificial
  Synthethic
uuugugccuguuuuaugugca

SEQ ID NO: 2169 - DNA, 23 bp, Artificial
  Synthethic
ugcacauaaaacaggcacaaaga

SEQ ID NO: 2170 - DNA, 21 bp, Artificial
  Synthethic
uugugccuguuuuaugugcaa

SEQ ID NO: 2171 - DNA, 23 bp, Artificial
  Synthethic
uugcacauaaaacaggcacaaag

SEQ ID NO: 2172 - DNA, 21 bp, Artificial
  Synthethic
cugcaggaugauuguacagaa

SEQ ID NO: 2173 - DNA, 23 bp, Artificial
  Synthethic
uucuguacaaucauccugcagaa

SEQ ID NO: 2174 - DNA, 21 bp, Artificial
  Synthethic
caggucaugagagaaugggaa

SEQ ID NO: 2175 - DNA, 23 bp, Artificial
  Synthethic
uucccauucucucaugaccuggg

SEQ ID NO: 2176 - DNA, 21 bp, Artificial
  Synthethic
uaugugcacacauuaggcaua

SEQ ID NO: 2177 - DNA, 23 bp, Artificial
  Synthethic
uaugccuaaugugugcacauaaa

SEQ ID NO: 2178 - DNA, 21 bp, Artificial
  Synthethic
ugugcacacauuaggcauuga

SEQ ID NO: 2179 - DNA, 23 bp, Artificial
  Synthethic
ucaaugccuaaugugugcacaua

SEQ ID NO: 2180 - DNA, 21 bp, Artificial
  Synthethic
ggaugauuguacagaaucaua

SEQ ID NO: 2181 - DNA, 23 bp, Artificial
  Synthethic
uaugauucuguacaaucauccug

SEQ ID NO: 2182 - DNA, 21 bp, Artificial
  Synthethic
accauccagaacuggugcaaa

SEQ ID NO: 2183 - DNA, 23 bp, Artificial
  Synthethic
uuugcaccaguucuggaugguca

SEQ ID NO: 2184 - DNA, 21 bp, Artificial
  Synthethic
uaugcugaagaaguacgucca

SEQ ID NO: 2185 - DNA, 23 bp, Artificial
  Synthethic
uggacguacuucuucagcauauu

SEQ ID NO: 2186 - DNA, 21 bp, Artificial
  Synthethic
augcugaagaaguacguccga

SEQ ID NO: 2187 - DNA, 23 bp, Artificial
  Synthethic
ucggacguacuucuucagcauau

SEQ ID NO: 2188 - DNA, 21 bp, Artificial
  Synthethic
aaaccauugcuucacuaccca

SEQ ID NO: 2189 - DNA, 23 bp, Artificial
  Synthethic
uggguagugaagcaaugguuuug

SEQ ID NO: 2190 - DNA, 21 bp, Artificial
  Synthethic
aaccauugcuucacuacccaa

SEQ ID NO: 2191 - DNA, 23 bp, Artificial
  Synthethic
uuggguagugaagcaaugguuuu

SEQ ID NO: 2192 - DNA, 21 bp, Artificial
  Synthethic
caccgagagagaaugucccaa

SEQ ID NO: 2193 - DNA, 23 bp, Artificial
  Synthethic
uugggacauucucucucggugcu

SEQ ID NO: 2194 - DNA, 21 bp, Artificial
  Synthethic
guuguauauuauucuugugga

SEQ ID NO: 2195 - DNA, 23 bp, Artificial
  Synthethic
uccacaagaauaauauacaacug

SEQ ID NO: 2196 - DNA, 21 bp, Artificial
  Synthethic
uuaugugcacacauuaggcaa

SEQ ID NO: 2197 - DNA, 23 bp, Artificial
  Synthethic
uugccuaaugugugcacauaaaa

SEQ ID NO: 2198 - DNA, 21 bp, Artificial
  Synthethic
augugcacacauuaggcauua

SEQ ID NO: 2199 - DNA, 23 bp, Artificial
  Synthethic
uaaugccuaaugugugcacauaa

SEQ ID NO: 2200 - DNA, 21 bp, Artificial
  Synthethic
gugcacacauuaggcauugaa

SEQ ID NO: 2201 - DNA, 23 bp, Artificial
  Synthethic
uucaaugccuaaugugugcacau

SEQ ID NO: 2202 - DNA, 21 bp, Artificial
  Synthethic
ugauuguacagaaucauugca

SEQ ID NO: 2203 - DNA, 23 bp, Artificial
  Synthethic
ugcaaugauucuguacaaucauc

SEQ ID NO: 2204 - DNA, 21 bp, Artificial
  Synthethic
gcuucacuacccaucggugua

SEQ ID NO: 2205 - DNA, 23 bp, Artificial
  Synthethic
uacaccgauggguagugaagcaa

SEQ ID NO: 2206 - DNA, 21 bp, Artificial
  Synthethic
uuuuaugugcacacauuagga

SEQ ID NO: 2207 - DNA, 23 bp, Artificial
  Synthethic
uccuaaugugugcacauaaaaca

SEQ ID NO: 2208 - DNA, 21 bp, Artificial
  Synthethic
cgcuuucuacacuguauuaca

SEQ ID NO: 2209 - DNA, 23 bp, Artificial
  Synthethic
uguaauacaguguagaaagcgau

SEQ ID NO: 2210 - DNA, 21 bp, Artificial
  Synthethic
gcuuucuacacuguauuacaa

SEQ ID NO: 2211 - DNA, 23 bp, Artificial
  Synthethic
uuguaatacaguguagaaagcga

SEQ ID NO: 2212 - DNA, 21 bp, Artificial
  Synthethic
uucuacacuguauuacauaaa

SEQ ID NO: 2213 - DNA, 23 bp, Artificial
  Synthethic
uuuaugtaauacaguguagaaag

SEQ ID NO: 2214 - DNA, 21 bp, Artificial
  Synthethic
uuucuacacuguauuacauaa

SEQ ID NO: 2215 - DNA, 23 bp, Artificial
  Synthethic
uuauguaauacaguguagaaagc

SEQ ID NO: 2216 - DNA, 21 bp, Artificial
  Synthethic
auuuagcuguaucaaacuaga

SEQ ID NO: 2217 - DNA, 23 bp, Artificial
  Synthethic
ucuagutugauacagcuaaauuc

SEQ ID NO: 2218 - DNA, 21 bp, Artificial
  Synthethic
uuccugaucacuaugcauuua

SEQ ID NO: 2219 - DNA, 23 bp, Artificial
  Synthethic
uaaaugcauagugaucaggaaag

SEQ ID NO: 2220 - DNA, 21 bp, Artificial
  Synthethic
gugcuguaacacaaguagaua

SEQ ID NO: 2221 - DNA, 23 bp, Artificial
  Synthethic
uaucuacuuguguuacagcacag

SEQ ID NO: 2222 - DNA, 21 bp, Artificial
  Synthethic
uuuagcuguaucaaacuagua

SEQ ID NO: 2223 - DNA, 23 bp, Artificial
  Synthethic
uacuagtuugauacagcuaaauu

SEQ ID NO: 2224 - DNA, 21 bp, Artificial
  Synthethic
uuuccugaucacuaugcauua

SEQ ID NO: 2225 - DNA, 23 bp, Artificial
  Synthethic
uaaugcauagugaucaggaaagg

SEQ ID NO: 2226 - DNA, 21 bp, Artificial
  Synthethic
aauggguuuuguguacuguaa

SEQ ID NO: 2227 - DNA, 23 bp, Artificial
  Synthethic
uuacagtacacaaaacccauuaa

SEQ ID NO: 2228 - DNA, 21 bp, Artificial
  Synthethic
uuacuguacagauugcugcua

SEQ ID NO: 2229 - DNA, 23 bp, Artificial
  Synthethic
uagcagcaaucuguacaguaaaa

SEQ ID NO: 2230 - DNA, 21 bp, Artificial
  Synthethic
auuguacagaaucauugcuua

SEQ ID NO: 2231 - DNA, 23 bp, Artificial
  Synthethic
uaagcaaugauucuguacaauca

SEQ ID NO: 2232 - DNA, 21 bp, Artificial
  Synthethic
uuguacagaaucauugcuuaa

SEQ ID NO: 2233 - DNA, 23 bp, Artificial
  Synthethic
uuaagcaaugauucuguacaauc

SEQ ID NO: 2234 - DNA, 21 bp, Artificial
  Synthethic
auaugcugaagaaguacguca

SEQ ID NO: 2235 - DNA, 23 bp, Artificial
  Synthethic
ugacguacuucuucagcauauug

SEQ ID NO: 2236 - DNA, 21 bp, Artificial
  Synthethic
accauugcuucacuacccaua

SEQ ID NO: 2237 - DNA, 23 bp, Artificial
  Synthethic
uaugggtagugaagcaaugguuu

SEQ ID NO: 2238 - DNA, 21 bp, Artificial
  Synthethic
cugugcuguaacacaaguaga

SEQ ID NO: 2239 - DNA, 23 bp, Artificial
  Synthethic
ucuacutguguuacagcacagcu

SEQ ID NO: 2240 - DNA, 21 bp, Artificial
  Synthethic
ugcuguaacacaaguagauga

SEQ ID NO: 2241 - DNA, 23 bp, Artificial
  Synthethic
ucaucuacuuguguuacagcaca

SEQ ID NO: 2242 - DNA, 21 bp, Artificial
  Synthethic
acagcugugcuguaacacaaa

SEQ ID NO: 2243 - DNA, 23 bp, Artificial
  Synthethic
uuugugtuacagcacagcuguca

SEQ ID NO: 2244 - DNA, 21 bp, Artificial
  Synthethic
gcuguaacacaaguagaugca

SEQ ID NO: 2245 - DNA, 23 bp, Artificial
  Synthethic
ugcauctacuuguguuacagcac

SEQ ID NO: 2246 - DNA, 21 bp, Artificial
  Synthethic
ucaaacuagugcaugaauaga

SEQ ID NO: 2247 - DNA, 23 bp, Artificial
  Synthethic
ucuauucaugcacuaguuugaua

SEQ ID NO: 2248 - DNA, 21 bp, Artificial
  Synthethic
caaacuagugcaugaauagaa

SEQ ID NO: 2249 - DNA, 23 bp, Artificial
  Synthethic
uucuautcaugcacuaguuugau

SEQ ID NO: 2250 - DNA, 21 bp, Artificial
  Synthethic
ugcaggaugauuguacagaaa

SEQ ID NO: 2251 - DNA, 23 bp, Artificial
  Synthethic
uuucugtacaaucauccugcaga

SEQ ID NO: 2252 - DNA, 21 bp, Artificial
  Synthethic
gcaggaugauuguacagaaua

SEQ ID NO: 2253 - DNA, 23 bp, Artificial
  Synthethic
uauucuguacaaucauccugcag

SEQ ID NO: 2254 - DNA, 21 bp, Artificial
  Synthethic
caggaugauuguacagaauca

SEQ ID NO: 2255 - DNA, 23 bp, Artificial
  Synthethic
ugauuctguacaaucauccugca

SEQ ID NO: 2256 - DNA, 21 bp, Artificial
  Synthethic
uaucaaacuagugcaugaaua

SEQ ID NO: 2257 - DNA, 23 bp, Artificial
  Synthethic
uauucatgcacuaguuugauaca

SEQ ID NO: 2258 - DNA, 21 bp, Artificial
  Synthethic
uuugugccuguuuuaugugca

SEQ ID NO: 2259 - DNA, 23 bp, Artificial
  Synthethic
ugcacataaaacaggcacaaaga

SEQ ID NO: 2260 - DNA, 21 bp, Artificial
  Synthethic
uugugccuguuuuaugugcaa

SEQ ID NO: 2261 - DNA, 23 bp, Artificial
  Synthethic
uugcacauaaaacaggcacaaag

SEQ ID NO: 2262 - DNA, 21 bp, Artificial
  Synthethic
cugcaggaugauuguacagaa

SEQ ID NO: 2263 - DNA, 23 bp, Artificial
  Synthethic
uucuguacaaucauccugcagaa

SEQ ID NO: 2264 - DNA, 21 bp, Artificial
  Synthethic
caggucaugagagaaugggaa

SEQ ID NO: 2265 - DNA, 23 bp, Artificial
  Synthethic
uucccatucucucaugaccuggg

SEQ ID NO: 2266 - DNA, 21 bp, Artificial
  Synthethic
uaugcugaagaaguacgucca

SEQ ID NO: 2267 - DNA, 23 bp, Artificial
  Synthethic
uggacgtacuucuucagcauauu

SEQ ID NO: 2268 - DNA, 21 bp, Artificial
  Synthethic
augcugaagaaguacguccga

SEQ ID NO: 2269 - DNA, 23 bp, Artificial
  Synthethic
ucggacguacuucuucagcauau

SEQ ID NO: 2270 - DNA, 21 bp, Artificial
  Synthethic
aaaccauugcuucacuaccca

SEQ ID NO: 2271 - DNA, 23 bp, Artificial
  Synthethic
uggguagugaagcaaugguuuug

SEQ ID NO: 2272 - DNA, 21 bp, Artificial
  Synthethic
aaccauugcuucacuacccaa

SEQ ID NO: 2273 - DNA, 23 bp, Artificial
  Synthethic
uuggguagugaagcaaugguuuu

SEQ ID NO: 2274 - DNA, 21 bp, Artificial
  Synthethic
uaugugcacacauuaggcaua

SEQ ID NO: 2275 - DNA, 23 bp, Artificial
  Synthethic
uaugcctaaugugugcacauaaa

SEQ ID NO: 2276 - DNA, 21 bp, Artificial
  Synthethic
ugugcacacauuaggcauuga

SEQ ID NO: 2277 - DNA, 23 bp, Artificial
  Synthethic
ucaaugccuaaugugugcacaua

SEQ ID NO: 2278 - DNA, 21 bp, Artificial
  Synthethic
ggaugauuguacagaaucaua

SEQ ID NO: 2279 - DNA, 23 bp, Artificial
  Synthethic
uaugautcuguacaaucauccug

SEQ ID NO: 2280 - DNA, 21 bp, Artificial
  Synthethic
accauccagaacuggugcaaa

SEQ ID NO: 2281 - DNA, 23 bp, Artificial
  Synthethic
uuugcaccaguucuggaugguca

SEQ ID NO: 2282 - DNA, 21 bp, Artificial
  Synthethic
caccgagagagaaugucccaa

SEQ ID NO: 2283 - DNA, 23 bp, Artificial
  Synthethic
uugggacauucucucucggugcu

SEQ ID NO: 2284 - DNA, 21 bp, Artificial
  Synthethic
guuguauauuauucuugugga

SEQ ID NO: 2285 - DNA, 23 bp, Artificial
  Synthethic
uccacaagaauaauauacaacug

SEQ ID NO: 2286 - DNA, 21 bp, Artificial
  Synthethic
uuaugugcacacauuaggcaa

SEQ ID NO: 2287 - DNA, 23 bp, Artificial
  Synthethic
uugccuaaugugugcacauaaaa

SEQ ID NO: 2288 - DNA, 21 bp, Artificial
  Synthethic
augugcacacauuaggcauua

SEQ ID NO: 2289 - DNA, 23 bp, Artificial
  Synthethic
uaaugccuaaugugugcacauaa

SEQ ID NO: 2290 - DNA, 21 bp, Artificial
  Synthethic
gugcacacauuaggcauugaa

SEQ ID NO: 2291 - DNA, 23 bp, Artificial
  Synthethic
uucaaugccuaaugugugcacau

SEQ ID NO: 2292 - DNA, 21 bp, Artificial
  Synthethic
ugauuguacagaaucauugca

SEQ ID NO: 2293 - DNA, 23 bp, Artificial
  Synthethic
ugcaaugauucuguacaaucauc

SEQ ID NO: 2294 - DNA, 21 bp, Artificial
  Synthethic
gcuucacuacccaucggugua

SEQ ID NO: 2295 - DNA, 23 bp, Artificial
  Synthethic
uacaccgauggguagugaagcaa

SEQ ID NO: 2296 - DNA, 21 bp, Artificial
  Synthethic
uuuuaugugcacacauuagga

SEQ ID NO: 2297 - DNA, 23 bp, Artificial
  Synthethic
uccuaatgugugcacauaaaaca

SEQ ID NO: 2298 - DNA, 21 bp, Artificial
  Synthethic
uagugcaugaauagauucuca

SEQ ID NO: 2299 - DNA, 23 bp, Artificial
  Synthethic
ugagaatcuauucaugcacuagu

SEQ ID NO: 2300 - DNA, 21 bp, Artificial
  Synthethic
uagugcaugaauagauucuca

SEQ ID NO: 2301 - DNA, 23 bp, Artificial
  Synthethic
ugagaatcuauucaugcacuagu

SEQ ID NO: 2302 - DNA, 22 bp, Artificial
  Synthethic
uagugcaudgaauagauucuca

SEQ ID NO: 2303 - DNA, 23 bp, Artificial
  Synthethic
ugagaatcuauucaugcacuagu

SEQ ID NO: 2304 - DNA, 23 bp, Artificial
  Synthethic
uagugcaudgadauagauucuca

SEQ ID NO: 2305 - DNA, 23 bp, Artificial
  Synthethic
ugagaatcuauucaugcacuagu

SEQ ID NO: 2306 - DNA, 21 bp, Artificial
  Synthethic
uagugcaugaauagauucuca

SEQ ID NO: 2307 - DNA, 24 bp, Artificial
  Synthethic
udgagaatcuauucaugcacuagu

SEQ ID NO: 2308 - DNA, 21 bp, Artificial
  Synthethic
uagugcaugaauagauucuca

SEQ ID NO: 2309 - DNA, 23 bp, Artificial
  Synthethic
ugagaatcuauucaugcacuagu

SEQ ID NO: 2310 - DNA, 21 bp, Artificial
  Synthethic
uagugcaugaauagauucuca

SEQ ID NO: 2311 - DNA, 24 bp, Artificial
  Synthethic
ugagaatcuauucaudgcacuagu

SEQ ID NO: 2312 - DNA, 21 bp, Artificial
  Synthethic
uagugcaugaauagauucuca

SEQ ID NO: 2313 - DNA, 25 bp, Artificial
  Synthethic
ugagaatcuaudtcaudgcacuagu

SEQ ID NO: 2314 - DNA, 21 bp, Artificial
  Synthethic
uagugcaugaauagauucuca

SEQ ID NO: 2315 - DNA, 24 bp, Artificial
  Synthethic
ugagaatcuaudtcaugcacuagu

SEQ ID NO: 2316 - DNA, 21 bp, Artificial
  Synthethic
uagugcaugaauagauucuca

SEQ ID NO: 2317 - DNA, 25 bp, Artificial
  Synthethic
udgagaatcuauucaudgcacuagu

SEQ ID NO: 2318 - DNA, 21 bp, Artificial
  Synthethic
uagugcaugaauagauucuca

SEQ ID NO: 2319 - DNA, 26 bp, Artificial
  Synthethic
udgagaatcuaudtcaudgcacuagu

SEQ ID NO: 2320 - DNA, 22 bp, Artificial
  Synthethic
uagugcaudgaauagauucuca

SEQ ID NO: 2321 - DNA, 24 bp, Artificial
  Synthethic
udgagaatcuauucaugcacuagu

SEQ ID NO: 2322 - DNA, 22 bp, Artificial
  Synthethic
uagugcaudgaauagauucuca

SEQ ID NO: 2323 - DNA, 24 bp, Artificial
  Synthethic
ugagaatcuauucaudgcacuagu

SEQ ID NO: 2324 - DNA, 22 bp, Artificial
  Synthethic
uagugcaudgaauagauucuca

SEQ ID NO: 2325 - DNA, 25 bp, Artificial
  Synthethic
ugagaatcuaudtcaudgcacuagu

SEQ ID NO: 2326 - DNA, 22 bp, Artificial
  Synthethic
uagugcaudgaauagauucuca

SEQ ID NO: 2327 - DNA, 24 bp, Artificial
  Synthethic
ugagaatcuaudtcaugcacuagu

SEQ ID NO: 2328 - DNA, 22 bp, Artificial
  Synthethic
uagugcaudgaauagauucuca

SEQ ID NO: 2329 - DNA, 25 bp, Artificial
  Synthethic
udgagaatcuauucaudgcacuagu

SEQ ID NO: 2330 - DNA, 22 bp, Artificial
  Synthethic
uagugcaudgaauagauucuca

SEQ ID NO: 2331 - DNA, 25 bp, Artificial
  Synthethic
udgagaatcuauucaudgcacuagu

SEQ ID NO: 2332 - DNA, 22 bp, Artificial
  Synthethic
uagugcaudgaauagauucuca

SEQ ID NO: 2333 - DNA, 26 bp, Artificial
  Synthethic
udgagaatcuaudtcaudgcacuagu

SEQ ID NO: 2334 - DNA, 22 bp, Artificial
  Synthethic
uagugcaudgaauagauucuca

SEQ ID NO: 2335 - DNA, 26 bp, Artificial
  Synthethic
udgagaatcuaudtcaudgcacuagu

SEQ ID NO: 2336 - DNA, 23 bp, Artificial
  Synthethic
uagugcaudgadauagauucuca

SEQ ID NO: 2337 - DNA, 26 bp, Artificial
  Synthethic
udgagaatcuaudtcaudgcacuagu

SEQ ID NO: 2338 - DNA, 23 bp, Artificial
  Synthethic
uagugcaudgadauagauucuca

SEQ ID NO: 2339 - DNA, 26 bp, Artificial
  Synthethic
udgagaatcuaudtcaudgcacuagu

SEQ ID NO: 2340 - DNA, 23 bp, Artificial
  Synthethic
uagugcaudgadauagauucuca

SEQ ID NO: 2341 - DNA, 26 bp, Artificial
  Synthethic
udgagaatcuaudtcaudgcacuagu

SEQ ID NO: 2342 - DNA, 23 bp, Artificial
  Synthethic
uagugcaudgadauagauucuca

SEQ ID NO: 2343 - DNA, 25 bp, Artificial
  Synthethic
udgagaatcuauucaudgcacuagu

SEQ ID NO: 2344 - DNA, 23 bp, Artificial
  Synthethic
uagugcaudgadauagauucuca

SEQ ID NO: 2345 - DNA, 27 bp, Artificial
  Synthethic
udgadgadaucuauucaudgcacuagu

SEQ ID NO: 2346 - DNA, 22 bp, Artificial
  Synthethic
uagugcaudgaauagauucuca

SEQ ID NO: 2347 - DNA, 25 bp, Artificial
  Synthethic
udgagaatcuauucaudgcacuagu

SEQ ID NO: 2348 - DNA, 22 bp, Artificial
  Synthethic
uagugcaudgaauagauucuca

SEQ ID NO: 2349 - DNA, 26 bp, Artificial
  Synthethic
udgagadatcuauucaudgcacuagu

SEQ ID NO: 2350 - DNA, 22 bp, Artificial
  Synthethic
uagugcaudgaauagauucuca

SEQ ID NO: 2351 - DNA, 26 bp, Artificial
  Synthethic
udgagdaatcuauucaudgcacuagu

SEQ ID NO: 2352 - DNA, 22 bp, Artificial
  Synthethic
uagugcaudgaauagauucuca

SEQ ID NO: 2353 - DNA, 27 bp, Artificial
  Synthethic
udgagadatcuaudtcaudgcacuagu

SEQ ID NO: 2354 - DNA, 22 bp, Artificial
  Synthethic
uagugcaudgaauagauucuca

SEQ ID NO: 2355 - DNA, 27 bp, Artificial
  Synthethic
udgagdaatcuaudtcaudgcacuagu

SEQ ID NO: 2356 - DNA, 22 bp, Artificial
  Synthethic
uagugcaudgaauagauucuca

SEQ ID NO: 2357 - DNA, 26 bp, Artificial
  Synthethic
udgagadatcuaudtcaugcacuagu

SEQ ID NO: 2358 - DNA, 22 bp, Artificial
  Synthethic
uagugcaudgaauagauucuca

SEQ ID NO: 2359 - DNA, 26 bp, Artificial
  Synthethic
udgagdaatcuaudtcaugcacuagu

SEQ ID NO: 2360 - DNA, 23 bp, Artificial
  Synthethic
uagugcaudgadauagauucuca

SEQ ID NO: 2361 - DNA, 26 bp, Artificial
  Synthethic
udgagdaatcuaudtcaugcacuagu

SEQ ID NO: 2362 - DNA, 22 bp, Artificial
  Synthethic
uagugcaudgaauagauucuca

SEQ ID NO: 2363 - DNA, 26 bp, Artificial
  Synthethic
udgagadatcuauucaudgcacuagu

SEQ ID NO: 2364 - DNA, 22 bp, Artificial
  Synthethic
uagugcaudgaauagauucuca

SEQ ID NO: 2365 - DNA, 26 bp, Artificial
  Synthethic
udgagdaatcuauucaudgcacuagu

SEQ ID NO: 2366 - DNA, 22 bp, Artificial
  Synthethic
uagugcaudgaauagauucuca

SEQ ID NO: 2367 - DNA, 27 bp, Artificial
  Synthethic
udgagadatcuaudtcaudgcacuagu

SEQ ID NO: 2368 - DNA, 22 bp, Artificial
  Synthethic
uagugcaudgaauagauucuca

SEQ ID NO: 2369 - DNA, 27 bp, Artificial
  Synthethic
udgagdaatcuaudtcaudgcacuagu

SEQ ID NO: 2370 - DNA, 22 bp, Artificial
  Synthethic
uagugcaudgaauagauucuca

SEQ ID NO: 2371 - DNA, 26 bp, Artificial
  Synthethic
udgagadatcuaudtcaugcacuagu

SEQ ID NO: 2372 - DNA, 22 bp, Artificial
  Synthethic
uagugcaudgaauagauucuca

SEQ ID NO: 2373 - DNA, 26 bp, Artificial
  Synthethic
udgagdaatcuaudtcaugcacuagu

SEQ ID NO: 2374 - DNA, 21 bp, Artificial
  Synthethic
uagugcaugaauagauucuca

SEQ ID NO: 2375 - DNA, 23 bp, Artificial
  Synthethic
ugagaatcuauucaugcacuaug

SEQ ID NO: 2376 - DNA, 22 bp, Artificial
  Synthethic
uagugcaudgaauagauucuca

SEQ ID NO: 2377 - DNA, 27 bp, Artificial
  Synthethic
udgagadatcuaudtcaudgcacuaug

SEQ ID NO: 2378 - DNA, 22 bp, Artificial
  Synthethic
uagugcaudgaauagauucuca

SEQ ID NO: 2379 - DNA, 27 bp, Artificial
  Synthethic
udgagdaatcuaudtcaudgcacuaug

SEQ ID NO: 2380 - DNA, 21 bp, Artificial
  Synthethic
ggcuacgaaaauccaaccuaa

SEQ ID NO: 2381 - DNA, 23 bp, Artificial
  Synthethic
uuaggutggauuuucguagccgu

SEQ ID NO: 2382 - DNA, 21 bp, Artificial
  Synthethic
ggcuacgaaaauccaaccuaa

SEQ ID NO: 2383 - DNA, 23 bp, Artificial
  Synthethic
uuaggutggauuuucguagccgu

SEQ ID NO: 2384 - DNA, 22 bp, Artificial
  Synthethic
ggcuacdgaaaauccaaccuaa

SEQ ID NO: 2385 - DNA, 23 bp, Artificial
  Synthethic
uuaggutggauuuucguagccgu

SEQ ID NO: 2386 - DNA, 21 bp, Artificial
  Synthethic
ggcuacgaaaauccaaccuaa

SEQ ID NO: 2387 - DNA, 23 bp, Artificial
  Synthethic
uuaggutggauuuucguagccgu

SEQ ID NO: 2388 - DNA, 21 bp, Artificial
  Synthethic
ggcuacgaaaauccaaccuaa

SEQ ID NO: 2389 - DNA, 23 bp, Artificial
  Synthethic
uuaggutggauuuucguagccgu

SEQ ID NO: 2390 - DNA, 21 bp, Artificial
  Synthethic
ggcuacgaaaauccaaccuaa

SEQ ID NO: 2391 - DNA, 24 bp, Artificial
  Synthethic
uuaggutggauuuucdguagccgu

SEQ ID NO: 2392 - DNA, 21 bp, Artificial
  Synthethic
ggcuacgaaaauccaaccuaa

SEQ ID NO: 2393 - DNA, 25 bp, Artificial
  Synthethic
uuaggutggaudtuucdguagccgu

SEQ ID NO: 2394 - DNA, 21 bp, Artificial
  Synthethic
ggcuacgaaaauccaaccuaa

SEQ ID NO: 2395 - DNA, 25 bp, Artificial
  Synthethic
uuaggutggaudtuucdguagccgu

SEQ ID NO: 2396 - DNA, 21 bp, Artificial
  Synthethic
ggcuacgaaaauccaaccuaa

SEQ ID NO: 2397 - DNA, 24 bp, Artificial
  Synthethic
uuaggutggauuuucdguagccgu

SEQ ID NO: 2398 - DNA, 23 bp, Artificial
  Synthethic
ggcuacgadaadauccaaccuaa

SEQ ID NO: 2399 - DNA, 25 bp, Artificial
  Synthethic
uuaggutggaudtuucdguagccgu

SEQ ID NO: 2400 - DNA, 21 bp, Artificial
  Synthethic
ggcuacgaaaauccaaccuaa

SEQ ID NO: 2401 - DNA, 24 bp, Artificial
  Synthethic
uuaggutggaudtuucguagccgu

SEQ ID NO: 2402 - DNA, 21 bp, Artificial
  Synthethic
ggcuacgaaaauccaaccuaa

SEQ ID NO: 2403 - DNA, 24 bp, Artificial
  Synthethic
uuaggutggaudtuucguagccgu

SEQ ID NO: 2404 - DNA, 21 bp, Artificial
  Synthethic
ggcuacgaaaauccaaccuaa

SEQ ID NO: 2405 - DNA, 23 bp, Artificial
  Synthethic
uuaggutggauuuucguagccgu

SEQ ID NO: 2406 - DNA, 23 bp, Artificial
  Synthethic
ggcuacgadaadauccaaccuaa

SEQ ID NO: 2407 - DNA, 24 bp, Artificial
  Synthethic
uuaggutggaudtuucguagccgu

SEQ ID NO: 2408 - DNA, 21 bp, Artificial
  Synthethic
ggcuacgaaaauccaaccuaa

SEQ ID NO: 2409 - DNA, 23 bp, Artificial
  Synthethic
uuaggutggauuuucguagccgu

SEQ ID NO: 2410 - DNA, 21 bp, Artificial
  Synthethic
ggcuacgaaaauccaaccuaa

SEQ ID NO: 2411 - DNA, 24 bp, Artificial
  Synthethic
uuaggutggauuuucdguagccgu

SEQ ID NO: 2412 - DNA, 21 bp, Artificial
  Synthethic
ggcuacgaaaauccaaccuaa

SEQ ID NO: 2413 - DNA, 25 bp, Artificial
  Synthethic
uuaggutggaudtuucdguagccgu

SEQ ID NO: 2414 - DNA, 21 bp, Artificial
  Synthethic
ggcuacgaaaauccaaccuaa

SEQ ID NO: 2415 - DNA, 24 bp, Artificial
  Synthethic
uuaggutggaudtuucguagccgu

SEQ ID NO: 2416 - DNA, 21 bp, Artificial
  Synthethic
ggcuacgaaaauccaaccuaa

SEQ ID NO: 2417 - DNA, 24 bp, Artificial
  Synthethic
uuaggdttggauuuucguagccgu

SEQ ID NO: 2418 - DNA, 21 bp, Artificial
  Synthethic
ggcuacgaaaauccaaccuaa

SEQ ID NO: 2419 - DNA, 25 bp, Artificial
  Synthethic
uuaggdttggauuuucdguagccgu

SEQ ID NO: 2420 - DNA, 21 bp, Artificial
  Synthethic
ggcuacgaaaauccaaccuaa

SEQ ID NO: 2421 - DNA, 26 bp, Artificial
  Synthethic
uuaggdttggaudtuucdguagccgu

SEQ ID NO: 2422 - DNA, 21 bp, Artificial
  Synthethic
ggcuacgaaaauccaaccuaa

SEQ ID NO: 2423 - DNA, 25 bp, Artificial
  Synthethic
uuaggdttggaudtuucguagccgu

SEQ ID NO: 2424 - DNA, 21 bp, Artificial
  Synthethic
ggcuacgaaaauccaaccuaa

SEQ ID NO: 2425 - DNA, 24 bp, Artificial
  Synthethic
uuagdgutggauuuucguagccgu

SEQ ID NO: 2426 - DNA, 21 bp, Artificial
  Synthethic
ggcuacgaaaauccaaccuaa

SEQ ID NO: 2427 - DNA, 25 bp, Artificial
  Synthethic
uuagdgutggauuuucdguagccgu

SEQ ID NO: 2428 - DNA, 21 bp, Artificial
  Synthethic
ggcuacgaaaauccaaccuaa

SEQ ID NO: 2429 - DNA, 26 bp, Artificial
  Synthethic
uuagdgutggaudtuucdguagccgu

SEQ ID NO: 2430 - DNA, 21 bp, Artificial
  Synthethic
ggcuacgaaaauccaaccuaa

SEQ ID NO: 2431 - DNA, 25 bp, Artificial
  Synthethic
uuagdgutggaudtuucguagccgu

SEQ ID NO: 2432 - DNA, 21 bp, Artificial
  Synthethic
ggcuacgaaaauccaaccuaa

SEQ ID NO: 2433 - DNA, 23 bp, Artificial
  Synthethic
uuaggutggauuuucguagccug

SEQ ID NO: 2434 - DNA, 21 bp, Artificial
  Synthethic
ggcuacgaaaauccaaccuaa

SEQ ID NO: 2435 - DNA, 24 bp, Artificial
  Synthethic
uuaggutggauuuucdguagccug

SEQ ID NO: 2436 - DNA, 21 bp, Artificial
  Synthethic
ggcuacgaaaauccaaccuaa

SEQ ID NO: 2437 - DNA, 26 bp, Artificial
  Synthethic
uuaggdttggaudtuucdguagccug

SEQ ID NO: 2438 - DNA, 21 bp, Artificial
  Synthethic
ggcuacgaaaauccaaccuaa

SEQ ID NO: 2439 - DNA, 26 bp, Artificial
  Synthethic
uuagdgutggaudtuucdguagccug

SEQ ID NO: 2440 - DNA, 21 bp, Artificial
  Synthethic
aaagagcaaaacuauucagaa

SEQ ID NO: 2441 - DNA, 23 bp, Artificial
  Synthethic
uucugaauaguuuugcucuuucu

SEQ ID NO: 2442 - DNA, 21 bp, Artificial
  Synthethic
aaagagcaaaacuauucagaa

SEQ ID NO: 2443 - DNA, 23 bp, Artificial
  Synthethic
uucugaauaguuuugcucuuucu

SEQ ID NO: 2444 - DNA, 21 bp, Artificial
  Synthethic
aaagagcaaaacuauucagaa

SEQ ID NO: 2445 - DNA, 23 bp, Artificial
  Synthethic
uucugaauaguuuugcucuuucu

SEQ ID NO: 2446 - DNA, 21 bp, Artificial
  Synthethic
aaagagcaaaacuauucagaa

SEQ ID NO: 2447 - DNA, 23 bp, Artificial
  Synthethic
uucugaauaguuuugcucuuucu

SEQ ID NO: 2448 - DNA, 21 bp, Artificial
  Synthethic
aaagagcaaaacuauucagaa

SEQ ID NO: 2449 - DNA, 23 bp, Artificial
  Synthethic
uucugaauaguuuugcucuuucu

SEQ ID NO: 2450 - DNA, 21 bp, Artificial
  Synthethic
aaagagcaaaacuauucagaa

SEQ ID NO: 2451 - DNA, 23 bp, Artificial
  Synthethic
uucugaauaguuuugcucuuucu

SEQ ID NO: 2452 - DNA, 21 bp, Artificial
  Synthethic
aaagagcaaaacuauucagaa

SEQ ID NO: 2453 - DNA, 23 bp, Artificial
  Synthethic
uucugaauaguuuugcucuuucu

SEQ ID NO: 2454 - DNA, 21 bp, Artificial
  Synthethic
aaagagcaaaacuauucagaa

SEQ ID NO: 2455 - DNA, 23 bp, Artificial
  Synthethic
uucugaauaguuuugcucuuucu

SEQ ID NO: 2456 - DNA, 21 bp, Artificial
  Synthethic
aaagagcaaaacuauucagaa

SEQ ID NO: 2457 - DNA, 23 bp, Artificial
  Synthethic
uucugaauaguuuugcucuuucu

SEQ ID NO: 2458 - DNA, 21 bp, Artificial
  Synthethic
aaagagcaaaacuauucagaa

SEQ ID NO: 2459 - DNA, 23 bp, Artificial
  Synthethic
uucugaauaguuuugcucuuucu

SEQ ID NO: 2460 - DNA, 21 bp, Artificial
  Synthethic
aaagagcaaaacuauucagaa

SEQ ID NO: 2461 - DNA, 23 bp, Artificial
  Synthethic
uucugaauaguuuugcucuuucu

SEQ ID NO: 2462 - DNA, 21 bp, Artificial
  Synthethic
aaagagcaaaacuauucagaa

SEQ ID NO: 2463 - DNA, 23 bp, Artificial
  Synthethic
uucugaauaguuuugcucuuucu

SEQ ID NO: 2464 - DNA, 21 bp, Artificial
  Synthethic
aaagagcaaaacuauucagaa

SEQ ID NO: 2465 - DNA, 23 bp, Artificial
  Synthethic
uucugaauaguuuugcucuuucu

SEQ ID NO: 2466 - DNA, 21 bp, Artificial
  Synthethic
aaagagcaaaacuauucagaa

SEQ ID NO: 2467 - DNA, 24 bp, Artificial
  Synthethic
uucugaauagudtuugcucuuucu

SEQ ID NO: 2468 - DNA, 23 bp, Artificial
  Synthethic
aaagagcadaadacuauucagaa

SEQ ID NO: 2469 - DNA, 24 bp, Artificial
  Synthethic
uucugaauagudtuugcucuuucu

SEQ ID NO: 2470 - DNA, 23 bp, Artificial
  Synthethic
aaagagcadaadacuauucagaa

SEQ ID NO: 2471 - DNA, 26 bp, Artificial
  Synthethic
uucugdaauagudtuugdcucuuucu

SEQ ID NO: 2472 - DNA, 21 bp, Artificial
  Synthethic
aaagagcaaaacuauucagaa

SEQ ID NO: 2473 - DNA, 23 bp, Artificial
  Synthethic
uucugaauaguuuugcucuuuug

SEQ ID NO: 2474 - DNA, 21 bp, Artificial
  Synthethic
aaagagcaaaacuauucagaa

SEQ ID NO: 2475 - DNA, 23 bp, Artificial
  Synthethic
uucugaauaguuuugcucuuuug

SEQ ID NO: 2476 - DNA, 21 bp, Artificial
  Synthethic
aaagagcaaaacuauucagaa

SEQ ID NO: 2477 - DNA, 23 bp, Artificial
  Synthethic
uucugaauaguuuugcucuuuug

SEQ ID NO: 2478 - DNA, 21 bp, Artificial
  Synthethic
uuuaugauuuacucauuauca

SEQ ID NO: 2479 - DNA, 23 bp, Artificial
  Synthethic
ugauaaugaguaaaucauaaaac

SEQ ID NO: 2480 - DNA, 21 bp, Artificial
  Synthethic
uuuaugauuuacucauuauca

SEQ ID NO: 2481 - DNA, 23 bp, Artificial
  Synthethic
ugauaaugaguaaaucauaaaac

SEQ ID NO: 2482 - DNA, 21 bp, Artificial
  Synthethic
uuuaugauuuacucauuauca

SEQ ID NO: 2483 - DNA, 23 bp, Artificial
  Synthethic
ugauaaugaguaaaucauaaaac

SEQ ID NO: 2484 - DNA, 21 bp, Artificial
  Synthethic
uuuaugauuuacucauuauca

SEQ ID NO: 2485 - DNA, 23 bp, Artificial
  Synthethic
ugauaaugaguaaaucauaaaac

SEQ ID NO: 2486 - DNA, 21 bp, Artificial
  Synthethic
uuuaugauuuacucauuauca

SEQ ID NO: 2487 - DNA, 23 bp, Artificial
  Synthethic
ugauaaugaguaaaucauaaaac

SEQ ID NO: 2488 - DNA, 21 bp, Artificial
  Synthethic
uuuaugauuuacucauuauca

SEQ ID NO: 2489 - DNA, 23 bp, Artificial
  Synthethic
ugauaaugaguaaaucauaaaac

SEQ ID NO: 2490 - DNA, 21 bp, Artificial
  Synthethic
uuuaugauuuacucauuauca

SEQ ID NO: 2491 - DNA, 23 bp, Artificial
  Synthethic
ugauaaugaguaaaucauaaaac

SEQ ID NO: 2492 - DNA, 21 bp, Artificial
  Synthethic
uuuaugauuuacucauuauca

SEQ ID NO: 2493 - DNA, 24 bp, Artificial
  Synthethic
udgauaaugaguaaaucauaaaac

SEQ ID NO: 2494 - DNA, 21 bp, Artificial
  Synthethic
uuuaugauuuacucauuauca

SEQ ID NO: 2495 - DNA, 24 bp, Artificial
  Synthethic
udgauaaugaguaaaucauaaaac

SEQ ID NO: 2496 - DNA, 21 bp, Artificial
  Synthethic
uuuaugauuuacucauuauca

SEQ ID NO: 2497 - DNA, 24 bp, Artificial
  Synthethic
udgauaaugaguaaaucauaaaac

SEQ ID NO: 2498 - DNA, 21 bp, Artificial
  Synthethic
uuuaugauuuacucauuauca

SEQ ID NO: 2499 - DNA, 24 bp, Artificial
  Synthethic
udgauaaugaguaaaucauaaaac

SEQ ID NO: 2500 - DNA, 21 bp, Artificial
  Synthethic
uuuaugauuuacucauuauca

SEQ ID NO: 2501 - DNA, 24 bp, Artificial
  Synthethic
udgauaaugaguaaaucauaaaac

SEQ ID NO: 2502 - DNA, 21 bp, Artificial
  Synthethic
uuuaugauuuacucauuauca

SEQ ID NO: 2503 - DNA, 24 bp, Artificial
  Synthethic
udgauaaugaguaaaucauaaaac

SEQ ID NO: 2504 - DNA, 21 bp, Artificial
  Synthethic
uuuaugauuuacucauuauca

SEQ ID NO: 2505 - DNA, 26 bp, Artificial
  Synthethic
udgauadaugagudaaaucauaaaac

SEQ ID NO: 2506 - DNA, 22 bp, Artificial
  Synthethic
uuuaugauuudacucauuauca

SEQ ID NO: 2507 - DNA, 26 bp, Artificial
  Synthethic
udgauadaugagudaaaucauaaaac

SEQ ID NO: 2508 - DNA, 22 bp, Artificial
  Synthethic
uuuaugauuudacucauuauca

SEQ ID NO: 2509 - DNA, 27 bp, Artificial
  Synthethic
udgauadaugagudaaaudcauaaaac

SEQ ID NO: 2510 - DNA, 21 bp, Artificial
  Synthethic
uuuaugauuuacucauuauca

SEQ ID NO: 2511 - DNA, 23 bp, Artificial
  Synthethic
ugauaaugaguaaaucauaaaug

SEQ ID NO: 2512 - DNA, 21 bp, Artificial
  Synthethic
uuuaugauuuacucauuauca

SEQ ID NO: 2513 - DNA, 24 bp, Artificial
  Synthethic
udgauaaugaguaaaucauaaaug

SEQ ID NO: 2514 - DNA, 21 bp, Artificial
  Synthethic
uuuaugauuuacucauuauca

SEQ ID NO: 2515 - DNA, 24 bp, Artificial
  Synthethic
udgauaaugaguaaaucauaaaug

SEQ ID NO: 2516 - DNA, 21 bp, Artificial
  Synthethic
uagugcaugaauagauucuca

SEQ ID NO: 2517 - DNA, 23 bp, Artificial
  Synthethic
ugagaatcuauucaugcacuagu

SEQ ID NO: 2518 - DNA, 21 bp, Artificial
  Synthethic
uagugcaugaauagauucuca

SEQ ID NO: 2519 - DNA, 23 bp, Artificial
  Synthethic
ugagaatcuauucaugcacuagu

SEQ ID NO: 2520 - DNA, 21 bp, Artificial
  Synthethic
uagugcaugaauagauucuca

SEQ ID NO: 2521 - DNA, 23 bp, Artificial
  Synthethic
ugagaatcuauucaugcacuagu

SEQ ID NO: 2522 - DNA, 21 bp, Artificial
  Synthethic
uagugcaugaauagauucuca

SEQ ID NO: 2523 - DNA, 23 bp, Artificial
  Synthethic
ugagaatcuauucaugcacuagu

SEQ ID NO: 2524 - DNA, 21 bp, Artificial
  Synthethic
uagugcaugaauagauucuca

SEQ ID NO: 2525 - DNA, 23 bp, Artificial
  Synthethic
ugagaatcuauucaugcacuagu

SEQ ID NO: 2526 - DNA, 21 bp, Artificial
  Synthethic
uagugcaugaauagauucuca

SEQ ID NO: 2527 - DNA, 23 bp, Artificial
  Synthethic
ugagaatcuauucaugcacuagu

SEQ ID NO: 2528 - DNA, 21 bp, Artificial
  Synthethic
uagugcaugaauagauucuca

SEQ ID NO: 2529 - DNA, 23 bp, Artificial
  Synthethic
ugagaatcuauucaugcacuagu

SEQ ID NO: 2530 - DNA, 21 bp, Artificial
  Synthethic
uagugcaugaauagauucuca

SEQ ID NO: 2531 - DNA, 23 bp, Artificial
  Synthethic
ugagaatcuautcaugcacuagu

SEQ ID NO: 2532 - DNA, 21 bp, Artificial
  Synthethic
uagugcaugaauagauucuca

SEQ ID NO: 2533 - DNA, 23 bp, Artificial
  Synthethic
ugagaatcuautcaugcacuagu

SEQ ID NO: 2534 - DNA, 21 bp, Artificial
  Synthethic
uagugcaugaauagauucuca

SEQ ID NO: 2535 - DNA, 23 bp, Artificial
  Synthethic
ugagaatcuauucaugcacuagu

SEQ ID NO: 2536 - DNA, 21 bp, Artificial
  Synthethic
uagugcaugaauagauucuca

SEQ ID NO: 2537 - DNA, 23 bp, Artificial
  Synthethic
ugagaatcuautcaugcacuagu

SEQ ID NO: 2538 - DNA, 21 bp, Artificial
  Synthethic
uagugcaugaauagauucuca

SEQ ID NO: 2539 - DNA, 23 bp, Artificial
  Synthethic
ugagaatcuauucaugcacuagu

SEQ ID NO: 2540 - DNA, 21 bp, Artificial
  Synthethic
uagugcaugaauagauucuca

SEQ ID NO: 2541 - DNA, 23 bp, Artificial
  Synthethic
ugagaatcuauucaugcacuagu

SEQ ID NO: 2542 - DNA, 21 bp, Artificial
  Synthethic
uagugcaugaauagauucuca

SEQ ID NO: 2543 - DNA, 23 bp, Artificial
  Synthethic
ugagaatcuautcaugcacuagu

SEQ ID NO: 2544 - DNA, 21 bp, Artificial
  Synthethic
uagugcaugaauagauucuca

SEQ ID NO: 2545 - DNA, 23 bp, Artificial
  Synthethic
ugagaatcuautcaugcacuagu

SEQ ID NO: 2546 - DNA, 21 bp, Artificial
  Synthethic
uagugcaugaauagauucuca

SEQ ID NO: 2547 - DNA, 23 bp, Artificial
  Synthethic
ugagaatcuauucaugcacuagu

SEQ ID NO: 2548 - DNA, 21 bp, Artificial
  Synthethic
uagugcaugaauagauucuca

SEQ ID NO: 2549 - DNA, 23 bp, Artificial
  Synthethic
ugagaatcuauucaugcacuagu

SEQ ID NO: 2550 - DNA, 21 bp, Artificial
  Synthethic
uagugcaugaauagauucuca

SEQ ID NO: 2551 - DNA, 23 bp, Artificial
  Synthethic
ugagaatcuautcaugcacuagu

SEQ ID NO: 2552 - DNA, 21 bp, Artificial
  Synthethic
uagugcaugaauagauucuca

SEQ ID NO: 2553 - DNA, 23 bp, Artificial
  Synthethic
ugagaatcuautcaugcacuagu

SEQ ID NO: 2554 - DNA, 21 bp, Artificial
  Synthethic
uagugcaugaauagauucuca

SEQ ID NO: 2555 - DNA, 23 bp, Artificial
  Synthethic
ugagaatcuautcaugcacuagu

SEQ ID NO: 2556 - DNA, 21 bp, Artificial
  Synthethic
uagugcaugaauagauucuca

SEQ ID NO: 2557 - DNA, 23 bp, Artificial
  Synthethic
ugagaatcuautcaugcacuagu

SEQ ID NO: 2558 - DNA, 21 bp, Artificial
  Synthethic
uagugcaugaauagauucuca

SEQ ID NO: 2559 - DNA, 23 bp, Artificial
  Synthethic
ugagaatcuautcaugcacuagu

SEQ ID NO: 2560 - DNA, 21 bp, Artificial
  Synthethic
uagugcaugaauagauucuca

SEQ ID NO: 2561 - DNA, 23 bp, Artificial
  Synthethic
ugagaatcuauucaugcacuagu

SEQ ID NO: 2562 - DNA, 21 bp, Artificial
  Synthethic
uagugcaugaauagauucuca

SEQ ID NO: 2563 - DNA, 23 bp, Artificial
  Synthethic
ugagaaucuauucaugcacuagu

SEQ ID NO: 2564 - DNA, 21 bp, Artificial
  Synthethic
uagugcaugaauagauucuca

SEQ ID NO: 2565 - DNA, 23 bp, Artificial
  Synthethic
ugagaatcuauucaugcacuagu

SEQ ID NO: 2566 - DNA, 21 bp, Artificial
  Synthethic
uagugcaugaauagauucuca

SEQ ID NO: 2567 - DNA, 23 bp, Artificial
  Synthethic
ugagaatcuauucaugcacuagu

SEQ ID NO: 2568 - DNA, 21 bp, Artificial
  Synthethic
uagugcaugaauagauucuca

SEQ ID NO: 2569 - DNA, 23 bp, Artificial
  Synthethic
ugagaatcuauucaugcacuagu

SEQ ID NO: 2570 - DNA, 21 bp, Artificial
  Synthethic
uagugcaugaauagauucuca

SEQ ID NO: 2571 - DNA, 23 bp, Artificial
  Synthethic
ugagaatcuautcaugcacuagu

SEQ ID NO: 2572 - DNA, 21 bp, Artificial
  Synthethic
uagugcaugaauagauucuca

SEQ ID NO: 2573 - DNA, 23 bp, Artificial
  Synthethic
ugagaatcuautcaugcacuagu

SEQ ID NO: 2574 - DNA, 21 bp, Artificial
  Synthethic
uagugcaugaauagauucuca

SEQ ID NO: 2575 - DNA, 23 bp, Artificial
  Synthethic
ugagaatcuautcaugcacuagu

SEQ ID NO: 2576 - DNA, 21 bp, Artificial
  Synthethic
uagugcaugaauagauucuca

SEQ ID NO: 2577 - DNA, 23 bp, Artificial
  Synthethic
ugagaatcuautcaugcacuagu

SEQ ID NO: 2578 - DNA, 21 bp, Artificial
  Synthethic
uagugcaugaauagauucuca

SEQ ID NO: 2579 - DNA, 23 bp, Artificial
  Synthethic
ugagaatcuautcaugcacuagu

SEQ ID NO: 2580 - DNA, 21 bp, Artificial
  Synthethic
uagugcaugaauagauucuca

SEQ ID NO: 2581 - DNA, 23 bp, Artificial
  Synthethic
ugagaatcuauucaugcacuagu

SEQ ID NO: 2582 - DNA, 21 bp, Artificial
  Synthethic
uagugcaugaauagauucuca

SEQ ID NO: 2583 - DNA, 23 bp, Artificial
  Synthethic
ugagaatcuauucaugcacuagu

SEQ ID NO: 2584 - DNA, 21 bp, Artificial
  Synthethic
uagugcaugaauagauucuca

SEQ ID NO: 2585 - DNA, 23 bp, Artificial
  Synthethic
ugagaatcuautcaugcacuagu

SEQ ID NO: 2586 - DNA, 21 bp, Artificial
  Synthethic
uagugcaugaauagauucuca

SEQ ID NO: 2587 - DNA, 23 bp, Artificial
  Synthethic
ugagaatcuautcaugcacuagu

SEQ ID NO: 2588 - DNA, 21 bp, Artificial
  Synthethic
uagugcaugaauagauucuca

SEQ ID NO: 2589 - DNA, 23 bp, Artificial
  Synthethic
ugagaatcuautcaugcacuagu

SEQ ID NO: 2590 - DNA, 21 bp, Artificial
  Synthethic
uagugcaugaauagauucuca

SEQ ID NO: 2591 - DNA, 23 bp, Artificial
  Synthethic
ugagaatcuautcaugcacuagu

SEQ ID NO: 2592 - DNA, 21 bp, Artificial
  Synthethic
uagugcaugaauagauucuca

SEQ ID NO: 2593 - DNA, 23 bp, Artificial
  Synthethic
ugagaatcuauucaugcacuaug

SEQ ID NO: 2594 - DNA, 21 bp, Artificial
  Synthethic
uagugcaugaauagauucuca

SEQ ID NO: 2595 - DNA, 23 bp, Artificial
  Synthethic
ugagaatcuautcaugcacuaug

SEQ ID NO: 2596 - DNA, 21 bp, Artificial
  Synthethic
uagugcaugaauagauucuca

SEQ ID NO: 2597 - DNA, 23 bp, Artificial
  Synthethic
ugagaatcuautcaugcacuaug

SEQ ID NO: 2598 - DNA, 21 bp, Artificial
  Synthethic
ggcuacgaaaauccaaccuaa

SEQ ID NO: 2599 - DNA, 23 bp, Artificial
  Synthethic
uuaggutggauuuucguagccgu

SEQ ID NO: 2600 - DNA, 21 bp, Artificial
  Synthethic
ggcuacgaaaauccaaccuaa

SEQ ID NO: 2601 - DNA, 23 bp, Artificial
  Synthethic
uuaggutggauuuucguagccgu

SEQ ID NO: 2602 - DNA, 21 bp, Artificial
  Synthethic
ggcuacgaaaauccaaccuaa

SEQ ID NO: 2603 - DNA, 23 bp, Artificial
  Synthethic
uuaggutggauuuucguagccgu

SEQ ID NO: 2604 - DNA, 21 bp, Artificial
  Synthethic
ggcuacgaaaauccaaccuaa

SEQ ID NO: 2605 - DNA, 23 bp, Artificial
  Synthethic
uuaggutggauuuucguagccgu

SEQ ID NO: 2606 - DNA, 21 bp, Artificial
  Synthethic
ggcuacgaaaauccaaccuaa

SEQ ID NO: 2607 - DNA, 23 bp, Artificial
  Synthethic
uuaggutggauuuucguagccgu

SEQ ID NO: 2608 - DNA, 21 bp, Artificial
  Synthethic
ggcuacgaaaauccaaccuaa

SEQ ID NO: 2609 - DNA, 23 bp, Artificial
  Synthethic
uuaggutggauuuucguagccgu

SEQ ID NO: 2610 - DNA, 21 bp, Artificial
  Synthethic
ggcuacgaaaauccaaccuaa

SEQ ID NO: 2611 - DNA, 23 bp, Artificial
  Synthethic
uuaggutggautuucguagccgu

SEQ ID NO: 2612 - DNA, 21 bp, Artificial
  Synthethic
ggcuacgaaaauccaaccuaa

SEQ ID NO: 2613 - DNA, 23 bp, Artificial
  Synthethic
uuaggutggautuucguagccgu

SEQ ID NO: 2614 - DNA, 21 bp, Artificial
  Synthethic
ggcuacgaaaauccaaccuaa

SEQ ID NO: 2615 - DNA, 23 bp, Artificial
  Synthethic
uuaggutggauuuucguagccgu

SEQ ID NO: 2616 - DNA, 21 bp, Artificial
  Synthethic
ggcuacgaaaauccaaccuaa

SEQ ID NO: 2617 - DNA, 23 bp, Artificial
  Synthethic
uuaggutggautuucguagccgu

SEQ ID NO: 2618 - DNA, 21 bp, Artificial
  Synthethic
ggcuacgaaaauccaaccuaa

SEQ ID NO: 2619 - DNA, 23 bp, Artificial
  Synthethic
uuaggutggautuucguagccgu

SEQ ID NO: 2620 - DNA, 21 bp, Artificial
  Synthethic
ggcuacgaaaauccaaccuaa

SEQ ID NO: 2621 - DNA, 23 bp, Artificial
  Synthethic
uuaggutggautuucguagccgu

SEQ ID NO: 2622 - DNA, 21 bp, Artificial
  Synthethic
ggcuacgaaaauccaaccuaa

SEQ ID NO: 2623 - DNA, 23 bp, Artificial
  Synthethic
uuaggutggauuuucguagccgu

SEQ ID NO: 2624 - DNA, 21 bp, Artificial
  Synthethic
ggcuacgaaaauccaaccuaa

SEQ ID NO: 2625 - DNA, 23 bp, Artificial
  Synthethic
uuaggutggautuucguagccgu

SEQ ID NO: 2626 - DNA, 21 bp, Artificial
  Synthethic
ggcuacgaaaauccaaccuaa

SEQ ID NO: 2627 - DNA, 23 bp, Artificial
  Synthethic
uuaggutggauuuucguagccgu

SEQ ID NO: 2628 - DNA, 21 bp, Artificial
  Synthethic
ggcuacgaaaauccaaccuaa

SEQ ID NO: 2629 - DNA, 23 bp, Artificial
  Synthethic
uuaggutggauuuucguagccgu

SEQ ID NO: 2630 - DNA, 21 bp, Artificial
  Synthethic
ggcuacgaaaauccaaccuaa

SEQ ID NO: 2631 - DNA, 23 bp, Artificial
  Synthethic
uuaggutggautuucguagccgu

SEQ ID NO: 2632 - DNA, 21 bp, Artificial
  Synthethic
ggcuacgaaaauccaaccuaa

SEQ ID NO: 2633 - DNA, 23 bp, Artificial
  Synthethic
uuaggutggautuucguagccgu

SEQ ID NO: 2634 - DNA, 21 bp, Artificial
  Synthethic
ggcuacgaaaauccaaccuaa

SEQ ID NO: 2635 - DNA, 23 bp, Artificial
  Synthethic
uuaggttggauuuucguagccgu

SEQ ID NO: 2636 - DNA, 21 bp, Artificial
  Synthethic
ggcuacgaaaauccaaccuaa

SEQ ID NO: 2637 - DNA, 23 bp, Artificial
  Synthethic
uuaggttggauuuucguagccgu

SEQ ID NO: 2638 - DNA, 21 bp, Artificial
  Synthethic
ggcuacgaaaauccaaccuaa

SEQ ID NO: 2639 - DNA, 23 bp, Artificial
  Synthethic
uuaggttggautuucguagccgu

SEQ ID NO: 2640 - DNA, 21 bp, Artificial
  Synthethic
ggcuacgaaaauccaaccuaa

SEQ ID NO: 2641 - DNA, 23 bp, Artificial
  Synthethic
uuaggttggautuucguagccgu

SEQ ID NO: 2642 - DNA, 21 bp, Artificial
  Synthethic
ggcuacgaaaauccaaccuaa

SEQ ID NO: 2643 - DNA, 23 bp, Artificial
  Synthethic
uuaggutggauuuucguagccgu

SEQ ID NO: 2644 - DNA, 21 bp, Artificial
  Synthethic
ggcuacgaaaauccaaccuaa

SEQ ID NO: 2645 - DNA, 23 bp, Artificial
  Synthethic
uuaggutggauuuucguagccgu

SEQ ID NO: 2646 - DNA, 21 bp, Artificial
  Synthethic
ggcuacgaaaauccaaccuaa

SEQ ID NO: 2647 - DNA, 23 bp, Artificial
  Synthethic
uuaggutggautuucguagccgu

SEQ ID NO: 2648 - DNA, 21 bp, Artificial
  Synthethic
ggcuacgaaaauccaaccuaa

SEQ ID NO: 2649 - DNA, 23 bp, Artificial
  Synthethic
uuaggutggautuucguagccgu

SEQ ID NO: 2650 - DNA, 21 bp, Artificial
  Synthethic
ggcuacgaaaauccaaccuaa

SEQ ID NO: 2651 - DNA, 23 bp, Artificial
  Synthethic
uuaggutggauuuucguagccug

SEQ ID NO: 2652 - DNA, 21 bp, Artificial
  Synthethic
ggcuacgaaaauccaaccuaa

SEQ ID NO: 2653 - DNA, 23 bp, Artificial
  Synthethic
uuaggutggauuuucguagccug

SEQ ID NO: 2654 - DNA, 21 bp, Artificial
  Synthethic
ggcuacgaaaauccaaccuaa

SEQ ID NO: 2655 - DNA, 23 bp, Artificial
  Synthethic
uuaggttggautuucguagccug

SEQ ID NO: 2656 - DNA, 21 bp, Artificial
  Synthethic
ggcuacgaaaauccaaccuaa

SEQ ID NO: 2657 - DNA, 23 bp, Artificial
  Synthethic
uuaggutggautuucguagccug

SEQ ID NO: 2658 - DNA, 21 bp, Artificial
  Synthethic
aaagagcaaaacuauucagaa

SEQ ID NO: 2659 - DNA, 23 bp, Artificial
  Synthethic
uucugaauaguuuugcucuuucu

SEQ ID NO: 2660 - DNA, 21 bp, Artificial
  Synthethic
aaagagcaaaacuauucagaa

SEQ ID NO: 2661 - DNA, 23 bp, Artificial
  Synthethic
uucugaauaguuuugcucuuucu

SEQ ID NO: 2662 - DNA, 21 bp, Artificial
  Synthethic
aaagagcaaaacuauucagaa

SEQ ID NO: 2663 - DNA, 23 bp, Artificial
  Synthethic
uucugaauaguuuugcucuuucu

SEQ ID NO: 2664 - DNA, 21 bp, Artificial
  Synthethic
aaagagcaaaacuauucagaa

SEQ ID NO: 2665 - DNA, 23 bp, Artificial
  Synthethic
uucugaauaguuuugcucuuucu

SEQ ID NO: 2666 - DNA, 21 bp, Artificial
  Synthethic
aaagagcaaaacuauucagaa

SEQ ID NO: 2667 - DNA, 23 bp, Artificial
  Synthethic
uucugaauaguuuugcucuuucu

SEQ ID NO: 2668 - DNA, 21 bp, Artificial
  Synthethic
aaagagcaaaacuauucagaa

SEQ ID NO: 2669 - DNA, 23 bp, Artificial
  Synthethic
uucugaauaguuuugcucuuucu

SEQ ID NO: 2670 - DNA, 21 bp, Artificial
  Synthethic
aaagagcaaaacuauucagaa

SEQ ID NO: 2671 - DNA, 23 bp, Artificial
  Synthethic
uucugaauaguuuugcucuuucu

SEQ ID NO: 2672 - DNA, 21 bp, Artificial
  Synthethic
aaagagcaaaacuauucagaa

SEQ ID NO: 2673 - DNA, 23 bp, Artificial
  Synthethic
uucugaauaguuuugcucuuucu

SEQ ID NO: 2674 - DNA, 21 bp, Artificial
  Synthethic
aaagagcaaaacuauucagaa

SEQ ID NO: 2675 - DNA, 23 bp, Artificial
  Synthethic
uucugaauaguuuugcucuuucu

SEQ ID NO: 2676 - DNA, 21 bp, Artificial
  Synthethic
aaagagcaaaacuauucagaa

SEQ ID NO: 2677 - DNA, 23 bp, Artificial
  Synthethic
uucugaauaguuuugcucuuucu

SEQ ID NO: 2678 - DNA, 21 bp, Artificial
  Synthethic
aaagagcaaaacuauucagaa

SEQ ID NO: 2679 - DNA, 23 bp, Artificial
  Synthethic
uucugaauaguuuugcucuuucu

SEQ ID NO: 2680 - DNA, 21 bp, Artificial
  Synthethic
aaagagcaaaacuauucagaa

SEQ ID NO: 2681 - DNA, 23 bp, Artificial
  Synthethic
uucugaauaguuuugcucuuucu

SEQ ID NO: 2682 - DNA, 21 bp, Artificial
  Synthethic
aaagagcaaaacuauucagaa

SEQ ID NO: 2683 - DNA, 23 bp, Artificial
  Synthethic
uucugaauaguuuugcucuuucu

SEQ ID NO: 2684 - DNA, 21 bp, Artificial
  Synthethic
aaagagcaaaacuauucagaa

SEQ ID NO: 2685 - DNA, 23 bp, Artificial
  Synthethic
uucugaauagutuugcucuuucu

SEQ ID NO: 2686 - DNA, 21 bp, Artificial
  Synthethic
aaagagcaaaacuauucagaa

SEQ ID NO: 2687 - DNA, 23 bp, Artificial
  Synthethic
uucugaauagutuugcucuuucu

SEQ ID NO: 2688 - DNA, 21 bp, Artificial
  Synthethic
aaagagcaaaacuauucagaa

SEQ ID NO: 2689 - DNA, 23 bp, Artificial
  Synthethic
uucugaauagutuugcucuuucu

SEQ ID NO: 2690 - DNA, 21 bp, Artificial
  Synthethic
aaagagcaaaacuauucagaa

SEQ ID NO: 2691 - DNA, 23 bp, Artificial
  Synthethic
uucugaauaguuuugcucuuuug

SEQ ID NO: 2692 - DNA, 21 bp, Artificial
  Synthethic
aaagagcaaaacuauucagaa

SEQ ID NO: 2693 - DNA, 23 bp, Artificial
  Synthethic
uucugaauaguuuugcucuuuug

SEQ ID NO: 2694 - DNA, 21 bp, Artificial
  Synthethic
aaagagcaaaacuauucagaa

SEQ ID NO: 2695 - DNA, 23 bp, Artificial
  Synthethic
uucugaauaguuuugcucuuuug

SEQ ID NO: 2696 - DNA, 21 bp, Artificial
  Synthethic
uuuaugauuuacucauuauca

SEQ ID NO: 2697 - DNA, 23 bp, Artificial
  Synthethic
ugauaaugaguaaaucauaaaac

SEQ ID NO: 2698 - DNA, 21 bp, Artificial
  Synthethic
uuuaugauuuacucauuauca

SEQ ID NO: 2699 - DNA, 23 bp, Artificial
  Synthethic
ugauaaugaguaaaucauaaaac

SEQ ID NO: 2700 - DNA, 21 bp, Artificial
  Synthethic
uuuaugauuuacucauuauca

SEQ ID NO: 2701 - DNA, 23 bp, Artificial
  Synthethic
ugauaaugaguaaaucauaaaac

SEQ ID NO: 2702 - DNA, 21 bp, Artificial
  Synthethic
uuuaugauuuacucauuauca

SEQ ID NO: 2703 - DNA, 23 bp, Artificial
  Synthethic
ugauaaugaguaaaucauaaaac

SEQ ID NO: 2704 - DNA, 21 bp, Artificial
  Synthethic
uuuaugauuuacucauuauca

SEQ ID NO: 2705 - DNA, 23 bp, Artificial
  Synthethic
ugauaaugaguaaaucauaaaac

SEQ ID NO: 2706 - DNA, 21 bp, Artificial
  Synthethic
uuuaugauuuacucauuauca

SEQ ID NO: 2707 - DNA, 23 bp, Artificial
  Synthethic
ugauaaugaguaaaucauaaaac

SEQ ID NO: 2708 - DNA, 21 bp, Artificial
  Synthethic
uuuaugauuuacucauuauca

SEQ ID NO: 2709 - DNA, 23 bp, Artificial
  Synthethic
ugauaaugaguaaaucauaaaac

SEQ ID NO: 2710 - DNA, 21 bp, Artificial
  Synthethic
uuuaugauuuacucauuauca

SEQ ID NO: 2711 - DNA, 23 bp, Artificial
  Synthethic
ugauaaugaguaaaucauaaaac

SEQ ID NO: 2712 - DNA, 21 bp, Artificial
  Synthethic
uuuaugauuuacucauuauca

SEQ ID NO: 2713 - DNA, 23 bp, Artificial
  Synthethic
ugauaaugaguaaaucauaaaac

SEQ ID NO: 2714 - DNA, 21 bp, Artificial
  Synthethic
uuuaugauuuacucauuauca

SEQ ID NO: 2715 - DNA, 23 bp, Artificial
  Synthethic
ugauaaugaguaaaucauaaaac

SEQ ID NO: 2716 - DNA, 21 bp, Artificial
  Synthethic
uuuaugauuuacucauuauca

SEQ ID NO: 2717 - DNA, 23 bp, Artificial
  Synthethic
ugauaaugaguaaaucauaaaac

SEQ ID NO: 2718 - DNA, 21 bp, Artificial
  Synthethic
uuuaugauuuacucauuauca

SEQ ID NO: 2719 - DNA, 23 bp, Artificial
  Synthethic
ugauaaugaguaaaucauaaaac

SEQ ID NO: 2720 - DNA, 21 bp, Artificial
  Synthethic
uuuaugauuuacucauuauca

SEQ ID NO: 2721 - DNA, 23 bp, Artificial
  Synthethic
ugauaaugaguaaaucauaaaac

SEQ ID NO: 2722 - DNA, 21 bp, Artificial
  Synthethic
uuuaugauuuacucauuauca

SEQ ID NO: 2723 - DNA, 23 bp, Artificial
  Synthethic
ugauaaugaguaaaucauaaaac

SEQ ID NO: 2724 - DNA, 21 bp, Artificial
  Synthethic
uuuaugauuuacucauuauca

SEQ ID NO: 2725 - DNA, 23 bp, Artificial
  Synthethic
ugauaaugaguaaaucauaaaac

SEQ ID NO: 2726 - DNA, 21 bp, Artificial
  Synthethic
uuuaugauuuacucauuauca

SEQ ID NO: 2727 - DNA, 23 bp, Artificial
  Synthethic
ugauaaugaguaaaucauaaaac

SEQ ID NO: 2728 - DNA, 21 bp, Artificial
  Synthethic
uuuaugauuuacucauuauca

SEQ ID NO: 2729 - DNA, 23 bp, Artificial
  Synthethic
ugauaaugaguaaaucauaaaug

SEQ ID NO: 2730 - DNA, 21 bp, Artificial
  Synthethic
uuuaugauuuacucauuauca

SEQ ID NO: 2731 - DNA, 23 bp, Artificial
  Synthethic
ugauaaugaguaaaucauaaaug

SEQ ID NO: 2732 - DNA, 21 bp, Artificial
  Synthethic
uuuaugauuuacucauuauca

SEQ ID NO: 2733 - DNA, 23 bp, Artificial
  Synthethic
ugauaaugaguaaaucauaaaug

SEQ ID NO: 2734 - DNA, 23 bp, Artificial
  Synthethic
ggcuacgadaadauccaaccuaa

SEQ ID NO: 2735 - DNA, 21 bp, Artificial
  Synthethic
ggcuacgaaaauccaaccuaa

SEQ ID NO: 2736 - DNA, 21 bp, Artificial
  Synthethic
aaagagcaaaacuauucagaa

SEQ ID NO: 2737 - DNA, 21 bp, Artificial
  Synthethic
aaagagcaaaacuauucagaa

SEQ ID NO: 2738 - DNA, 23 bp, Artificial
  Synthethic
aaagagcadaadacuauucagaa

SEQ ID NO: 2739 - DNA, 21 bp, Artificial
  Synthethic
aaagagcaaaacuauucagaa

SEQ ID NO: 2740 - DNA, 21 bp, Artificial
  Synthethic
uuuaugauuuacucauuauca

SEQ ID NO: 2741 - DNA, 21 bp, Artificial
  Synthethic
uuuaugauuuacucauuauca

SEQ ID NO: 2742 - DNA, 25 bp, Artificial
  Synthethic
uuaggutggaudtuucdguagccgu

SEQ ID NO: 2743 - DNA, 23 bp, Artificial
  Synthethic
uuaggutggautuucguagccgu

SEQ ID NO: 2744 - DNA, 24 bp, Artificial
  Synthethic
uucugaauagudtuugcucuuucu

SEQ ID NO: 2745 - DNA, 23 bp, Artificial
  Synthethic
uucugaauagutuugcucuuucu

SEQ ID NO: 2746 - DNA, 26 bp, Artificial
  Synthethic
uucugdaauagudtuugdcucuuucu

SEQ ID NO: 2747 - DNA, 23 bp, Artificial
  Synthethic
uucugaauagutuugcucuuucu

SEQ ID NO: 2748 - DNA, 23 bp, Artificial
  Synthethic
ugauaaugaguaaaucauaaaug

SEQ ID NO: 2749 - DNA, 23 bp, Artificial
  Synthethic
ugauaaugaguaaaucauaaaug

SEQ ID NO: 2750 - DNA, 21 bp, Artificial
  Synthethic
uagugcaugaauagauucucu

SEQ ID NO: 2751 - DNA, 23 bp, Artificial
  Synthethic
agagaatcuauucaugcacuagu

SEQ ID NO: 2752 - DNA, 21 bp, Artificial
  Synthethic
aaagagcaaaacuauucagau

SEQ ID NO: 2753 - DNA, 23 bp, Artificial
  Synthethic
aucugaauaguuuugcucuuucu

SEQ ID NO: 2754 - DNA, 23 bp, Artificial
  Synthethic
agaaagagcaaaacuauucagau

SEQ ID NO: 2755 - DNA, 21 bp, Artificial
  Synthethic
uuggccaacaugauuagugau

SEQ ID NO: 2756 - DNA, 23 bp, Artificial
  Synthethic
aucacuaaucauguuggccaaga

SEQ ID NO: 2757 - DNA, 23 bp, Artificial
  Synthethic
ucuuggccaacaugauuagugaa

SEQ ID NO: 2758 - DNA, 21 bp, Artificial
  Synthethic
ucuggguugacaaauaucaau

SEQ ID NO: 2759 - DNA, 23 bp, Artificial
  Synthethic
auugauauuugucaacccagaac

SEQ ID NO: 2760 - DNA, 23 bp, Artificial
  Synthethic
guucuggguugacaaauaucaag

SEQ ID NO: 2761 - DNA, 21 bp, Artificial
  Synthethic
uuuaugauuuacucauuaucu

SEQ ID NO: 2762 - DNA, 23 bp, Artificial
  Synthethic
agauaaugaguaaaucauaaaac

SEQ ID NO: 2763 - DNA, 23 bp, Artificial
  Synthethic
guuuuaugauuuacucauuaucg

SEQ ID NO: 2764 - DNA, 21 bp, Artificial
  Synthethic
augccugaacuugaauuaauu

SEQ ID NO: 2765 - DNA, 23 bp, Artificial
  Synthethic
aauuaauucaaguucaggcaucu

SEQ ID NO: 2766 - DNA, 23 bp, Artificial
  Synthethic
agaugccugaacuugaauuaauc

SEQ ID NO: 2767 - DNA, 21 bp, Artificial
  Synthethic
agaugccugaacuugaauuau

SEQ ID NO: 2768 - DNA, 23 bp, Artificial
  Synthethic
auaauucaaguucaggcaucuac

SEQ ID NO: 2769 - DNA, 23 bp, Artificial
  Synthethic
guagaugccugaacuugaauuaa

SEQ ID NO: 2770 - DNA, 21 bp, Artificial
  Synthethic
gccugaacuugaauuaauccu

SEQ ID NO: 2771 - DNA, 23 bp, Artificial
  Synthethic
aggauuaauucaaguucaggcau

SEQ ID NO: 2772 - DNA, 23 bp, Artificial
  Synthethic
augccugaacuugaauuaaucca

SEQ ID NO: 2773 - DNA, 21 bp, Artificial
  Synthethic
gugguuugugacccaauuaau

SEQ ID NO: 2774 - DNA, 23 bp, Artificial
  Synthethic
auuaauugggucacaaaccacaa

SEQ ID NO: 2775 - DNA, 23 bp, Artificial
  Synthethic
uugugguuugugacccaauuaag

SEQ ID NO: 2776 - DNA, 21 bp, Artificial
  Synthethic
cagaugcuuuagagagauuuu

SEQ ID NO: 2777 - DNA, 23 bp, Artificial
  Synthethic
aaaaucucucuaaagcaucugaa

SEQ ID NO: 2778 - DNA, 23 bp, Artificial
  Synthethic
uucagaugcuuuagagagauuuu

SEQ ID NO: 2779 - DNA, 21 bp, Artificial
  Synthethic
ucuugccuaaguauuccuuuu

SEQ ID NO: 2780 - DNA, 23 bp, Artificial
  Synthethic
aaaaggaauacuuaggcaagaga

SEQ ID NO: 2781 - DNA, 23 bp, Artificial
  Synthethic
ucucuugccuaaguauuccuuuc

SEQ ID NO: 2782 - DNA, 21 bp, Artificial
  Synthethic
uugcugcuucugcuauauuuu

SEQ ID NO: 2783 - DNA, 23 bp, Artificial
  Synthethic
aaaauauagcagaagcagcaauc

SEQ ID NO: 2784 - DNA, 23 bp, Artificial
  Synthethic
gauugcugcuucugcuauauuug

SEQ ID NO: 2785 - DNA, 21 bp, Artificial
  Synthethic
uagugcaugaauagauucuca

SEQ ID NO: 2786 - DNA, 23 bp, Artificial
  Synthethic
ugagaatcuauucaugcacuagu

SEQ ID NO: 2787 - DNA, 22 bp, Artificial
  Synthethic
uagugcaudgaauagauucuca

SEQ ID NO: 2788 - DNA, 25 bp, Artificial
  Synthethic
udgagaatcuauucaudgcacuagu

SEQ ID NO: 2789 - DNA, 23 bp, Artificial
  Synthethic
uagugcaudgadauagauucuca

SEQ ID NO: 2790 - DNA, 25 bp, Artificial
  Synthethic
udgagaatcuauucaudgcacuagu

SEQ ID NO: 2791 - DNA, 22 bp, Artificial
  Synthethic
uagugcaudgaauagauucuca

SEQ ID NO: 2792 - DNA, 26 bp, Artificial
  Synthethic
udgagdaatcuaudtcaugcacuagu

SEQ ID NO: 2793 - DNA, 22 bp, Artificial
  Synthethic
uagugcaudgaauagauucuca

SEQ ID NO: 2794 - DNA, 27 bp, Artificial
  Synthethic
udgagdaatcuaudtcaudgcacuagu

SEQ ID NO: 2795 - DNA, 21 bp, Artificial
  Synthethic
ggcuacgaaaauccaaccuaa

SEQ ID NO: 2796 - DNA, 23 bp, Artificial
  Synthethic
uuaggutggauuuucguagccgu

SEQ ID NO: 2797 - DNA, 23 bp, Artificial
  Synthethic
ggcuacgadaadauccaaccuaa

SEQ ID NO: 2798 - DNA, 25 bp, Artificial
  Synthethic
uuaggutggaudtuucdguagccgu

SEQ ID NO: 2799 - DNA, 23 bp, Artificial
  Synthethic
ggcuacgadaadauccaaccuaa

SEQ ID NO: 2800 - DNA, 24 bp, Artificial
  Synthethic
uuaggutggaudtuucguagccgu

SEQ ID NO: 2801 - DNA, 21 bp, Artificial
  Synthethic
ggcuacgaaaauccaaccuaa

SEQ ID NO: 2802 - DNA, 24 bp, Artificial
  Synthethic
uuaggutggauuuucdguagccgu

SEQ ID NO: 2803 - DNA, 21 bp, Artificial
  Synthethic
ggcuacgaaaauccaaccuaa

SEQ ID NO: 2804 - DNA, 25 bp, Artificial
  Synthethic
uuaggdttggauuuucdguagccgu

SEQ ID NO: 2805 - DNA, 21 bp, Artificial
  Synthethic
ggcuacgaaaauccaaccuaa

SEQ ID NO: 2806 - DNA, 26 bp, Artificial
  Synthethic
uuaggdttggaudtuucdguagccgu

SEQ ID NO: 2807 - DNA, 21 bp, Artificial
  Synthethic
ggcuacgaaaauccaaccuaa

SEQ ID NO: 2808 - DNA, 25 bp, Artificial
  Synthethic
uuagdgutggaudtuucguagccgu

SEQ ID NO: 2809 - DNA, 21 bp, Artificial
  Synthethic
aaagagcaaaacuauucagaa

SEQ ID NO: 2810 - DNA, 23 bp, Artificial
  Synthethic
uucugaauaguuuugcucuuucu

SEQ ID NO: 2811 - DNA, 21 bp, Artificial
  Synthethic
aaagagcaaaacuauucagaa

SEQ ID NO: 2812 - DNA, 23 bp, Artificial
  Synthethic
uucugaauaguuuugcucuuucu

SEQ ID NO: 2813 - DNA, 21 bp, Artificial
  Synthethic
aaagagcaaaacuauucagaa

SEQ ID NO: 2814 - DNA, 23 bp, Artificial
  Synthethic
uucugaauaguuuugcucuuucu

SEQ ID NO: 2815 - DNA, 21 bp, Artificial
  Synthethic
aaagagcaaaacuauucagaa

SEQ ID NO: 2816 - DNA, 24 bp, Artificial
  Synthethic
uucugaauagudtuugcucuuucu

SEQ ID NO: 2817 - DNA, 23 bp, Artificial
  Synthethic
aaagagcadaadacuauucagaa

SEQ ID NO: 2818 - DNA, 24 bp, Artificial
  Synthethic
uucugaauagudtuugcucuuucu

SEQ ID NO: 2819 - DNA, 23 bp, Artificial
  Synthethic
aaagagcadaadacuauucagaa

SEQ ID NO: 2820 - DNA, 26 bp, Artificial
  Synthethic
uucugdaauagudtuugdcucuuucu

SEQ ID NO: 2821 - DNA, 21 bp, Artificial
  Synthethic
uuuaugauuuacucauuauca

SEQ ID NO: 2822 - DNA, 23 bp, Artificial
  Synthethic
ugauaaugaguaaaucauaaaac

SEQ ID NO: 2823 - DNA, 22 bp, Artificial
  Synthethic
uuuaugauuudacucauuauca

SEQ ID NO: 2824 - DNA, 27 bp, Artificial
  Synthethic
udgauadaugagudaaaudcauaaaac

SEQ ID NO: 2825 - DNA, 21 bp, Artificial
  Synthethic
uuuaugauuuacucauuauca

SEQ ID NO: 2826 - DNA, 24 bp, Artificial
  Synthethic
udgauaaugaguaaaucauaaaug

SEQ ID NO: 2827 - DNA, 21 bp, Artificial
  Synthethic
uuuaugauuuacucauuauca

SEQ ID NO: 2828 - DNA, 24 bp, Artificial
  Synthethic
udgauaaugaguaaaucauaaaug

SEQ ID NO: 2829 - DNA, 21 bp, Artificial
  Synthethic
uagugcaugaauagauucuca

SEQ ID NO: 2830 - DNA, 23 bp, Artificial
  Synthethic
ugagaatcuauucaugcacuagu

SEQ ID NO: 2831 - DNA, 21 bp, Artificial
  Synthethic
uagugcaugaauagauucuca

SEQ ID NO: 2832 - DNA, 23 bp, Artificial
  Synthethic
ugagaatcuauucaugcacuagu

SEQ ID NO: 2833 - DNA, 21 bp, Artificial
  Synthethic
uagugcaugaauagauucuca

SEQ ID NO: 2834 - DNA, 23 bp, Artificial
  Synthethic
ugagaatcuauucaugcacuagu

SEQ ID NO: 2835 - DNA, 21 bp, Artificial
  Synthethic
uagugcaugaauagauucuca

SEQ ID NO: 2836 - DNA, 23 bp, Artificial
  Synthethic
ugagaatcuautcaugcacuagu

SEQ ID NO: 2837 - DNA, 21 bp, Artificial
  Synthethic
uagugcaugaauagauucuca

SEQ ID NO: 2838 - DNA, 23 bp, Artificial
  Synthethic
ugagaatcuautcaugcacuagu

SEQ ID NO: 2839 - DNA, 21 bp, Artificial
  Synthethic
ggcuacgaaaauccaaccuaa

SEQ ID NO: 2840 - DNA, 23 bp, Artificial
  Synthethic
uuaggutggauuuucguagccgu

SEQ ID NO: 2841 - DNA, 21 bp, Artificial
  Synthethic
ggcuacgaaaauccaaccuaa

SEQ ID NO: 2842 - DNA, 23 bp, Artificial
  Synthethic
uuaggutggautuucguagccgu

SEQ ID NO: 2843 - DNA, 21 bp, Artificial
  Synthethic
ggcuacgaaaauccaaccuaa

SEQ ID NO: 2844 - DNA, 23 bp, Artificial
  Synthethic
uuaggutggautuucguagccgu

SEQ ID NO: 2845 - DNA, 21 bp, Artificial
  Synthethic
ggcuacgaaaauccaaccuaa

SEQ ID NO: 2846 - DNA, 23 bp, Artificial
  Synthethic
uuaggutggauuuucguagccgu

SEQ ID NO: 2847 - DNA, 21 bp, Artificial
  Synthethic
ggcuacgaaaauccaaccuaa

SEQ ID NO: 2848 - DNA, 23 bp, Artificial
  Synthethic
uuaggttggauuuucguagccgu

SEQ ID NO: 2849 - DNA, 21 bp, Artificial
  Synthethic
ggcuacgaaaauccaaccuaa

SEQ ID NO: 2850 - DNA, 23 bp, Artificial
  Synthethic
uuaggttggautuucguagccgu

SEQ ID NO: 2851 - DNA, 21 bp, Artificial
  Synthethic
ggcuacgaaaauccaaccuaa

SEQ ID NO: 2852 - DNA, 23 bp, Artificial
  Synthethic
uuaggutggautuucguagccgu

SEQ ID NO: 2853 - DNA, 21 bp, Artificial
  Synthethic
aaagagcaaaacuauucagaa

SEQ ID NO: 2854 - DNA, 23 bp, Artificial
  Synthethic
uucugaauaguuuugcucuuucu

SEQ ID NO: 2855 - DNA, 21 bp, Artificial
  Synthethic
aaagagcaaaacuauucagaa

SEQ ID NO: 2856 - DNA, 23 bp, Artificial
  Synthethic
uucugaauaguuuugcucuuucu

SEQ ID NO: 2857 - DNA, 21 bp, Artificial
  Synthethic
aaagagcaaaacuauucagaa

SEQ ID NO: 2858 - DNA, 23 bp, Artificial
  Synthethic
uucugaauaguuuugcucuuucu

SEQ ID NO: 2859 - DNA, 21 bp, Artificial
  Synthethic
aaagagcaaaacuauucagaa

SEQ ID NO: 2860 - DNA, 23 bp, Artificial
  Synthethic
uucugaauagutuugcucuuucu

SEQ ID NO: 2861 - DNA, 21 bp, Artificial
  Synthethic
aaagagcaaaacuauucagaa

SEQ ID NO: 2862 - DNA, 23 bp, Artificial
  Synthethic
uucugaauagutuugcucuuucu

SEQ ID NO: 2863 - DNA, 21 bp, Artificial
  Synthethic
aaagagcaaaacuauucagaa

SEQ ID NO: 2864 - DNA, 23 bp, Artificial
  Synthethic
uucugaauagutuugcucuuucu

SEQ ID NO: 2865 - DNA, 21 bp, Artificial
  Synthethic
uuuaugauuuacucauuauca

SEQ ID NO: 2866 - DNA, 23 bp, Artificial
  Synthethic
ugauaaugaguaaaucauaaaac

SEQ ID NO: 2867 - DNA, 21 bp, Artificial
  Synthethic
uuuaugauuuacucauuauca

SEQ ID NO: 2868 - DNA, 23 bp, Artificial
  Synthethic
ugauaaugaguaaaucauaaaac

SEQ ID NO: 2869 - DNA, 21 bp, Artificial
  Synthethic
uuuaugauuuacucauuauca

SEQ ID NO: 2870 - DNA, 23 bp, Artificial
  Synthethic
ugauaaugaguaaaucauaaaug

SEQ ID NO: 2871 - DNA, 21 bp, Artificial
  Synthethic
uuuaugauuuacucauuauca

SEQ ID NO: 2872 - DNA, 23 bp, Artificial
  Synthethic
ugauaaugaguaaaucauaaaug

SEQ ID NO: 2873 - DNA, 21 bp, Artificial
  Synthethic
aaaauccaaccuacaaguuca

SEQ ID NO: 2874 - DNA, 23 bp, Artificial
  Synthethic
ugaacutguagguuggauuuucg

SEQ ID NO: 2875 - DNA, 23 bp, Artificial
  Synthethic
ggcuacgadaadauccaaccuaa

SEQ ID NO: 2876 - DNA, 25 bp, Artificial
  Synthethic
uuaggutggaudtuucdguagccgu

SEQ ID NO: 2877 - DNA, 21 bp, Artificial
  Synthethic
aaagagcaaaacuauucagaa

SEQ ID NO: 2878 - DNA, 24 bp, Artificial
  Synthethic
uucugaauagudtuugcucuuucu

SEQ ID NO: 2879 - DNA, 23 bp, Artificial
  Synthethic
aaagagcadaadacuauucagaa

SEQ ID NO: 2880 - DNA, 26 bp, Artificial
  Synthethic
uucugdaauagudtuugdcucuuucu

SEQ ID NO: 2881 - DNA, 21 bp, Artificial
  Synthethic
uuuaugauuuacucauuauca

SEQ ID NO: 2882 - DNA, 23 bp, Artificial
  Synthethic
ugauaaugaguaaaucauaaaug

SEQ ID NO: 2883 - DNA, 23 bp, Artificial
  Synthethic
cgaaaauccaaccuacaaguucu

SEQ ID NO: 2884 - DNA, 23 bp, Artificial
  Synthethic
agaacuuguagguuggauuuucg

SEQ ID NO: 2885 - DNA, 23 bp, Artificial
  Synthethic
acggcuacgaaaauccaaccuac

SEQ ID NO: 2886 - DNA, 23 bp, Artificial
  Synthethic
guagguuggauuuucguagccgu

SEQ ID NO: 2887 - DNA, 23 bp, Artificial
  Synthethic
agaaagagcaaaacuauucagau

SEQ ID NO: 2888 - DNA, 23 bp, Artificial
  Synthethic
aucugaauaguuuugcucuuucu

SEQ ID NO: 2889 - DNA, 23 bp, Artificial
  Synthethic
agaaagagcaaaacuauucagau

SEQ ID NO: 2890 - DNA, 23 bp, Artificial
  Synthethic
aucugaauaguuuugcucuuucu

SEQ ID NO: 2891 - DNA, 23 bp, Artificial
  Synthethic
guuuuaugauuuacucauuaucg

SEQ ID NO: 2892 - DNA, 23 bp, Artificial
  Synthethic
cgauaaugaguaaaucauaaaac

SEQ ID NO: 2893 - DNA, 21 bp, Artificial
  Synthethic
aaaauccaaccuacaaguuca

SEQ ID NO: 2894 - DNA, 23 bp, Artificial
  Synthethic
ugaacutguagguuggauuuucg

SEQ ID NO: 2895 - DNA, 21 bp, Artificial
  Synthethic
ggcuacgaaaauccaaccuaa

SEQ ID NO: 2896 - DNA, 23 bp, Artificial
  Synthethic
uuaggutggautuucguagccgu

SEQ ID NO: 2897 - DNA, 21 bp, Artificial
  Synthethic
aaagagcaaaacuauucagaa

SEQ ID NO: 2898 - DNA, 23 bp, Artificial
  Synthethic
uucugaauagutuugcucuuucu

SEQ ID NO: 2899 - DNA, 21 bp, Artificial
  Synthethic
aaagagcaaaacuauucagaa

SEQ ID NO: 2900 - DNA, 23 bp, Artificial
  Synthethic
uucugaauagutuugcucuuucu

SEQ ID NO: 2901 - DNA, 21 bp, Artificial
  Synthethic
uuuaugauuuacucauuauca

SEQ ID NO: 2902 - DNA, 23 bp, Artificial
  Synthethic
ugauaaugaguaaaucauaaaug

We claim:

1. A double stranded ribonucleic acid (RNAi) agent for inhibiting expression of an amyloid precursor protein (APP) gene, comprising:
   (a) a sense strand comprising the nucleotide sequence of 5'-GGCUACGAAAAUCCAACCUAA-3' (SEQ ID NO: 2735), wherein the sense strand comprises one or more lipophilic moieties conjugated to one or more non-terminal nucleotide positions excluding positions 9-12, wherein the 5' terminal G of SEQ ID NO: 2735 is position 1; and
   (b) an antisense strand comprising the nucleotide sequence of 5'-UUAGGUTGGAUTUUCGUAGCCGU-3' (SEQ ID NO:2743);
   wherein the double stranded RNAi agent comprises at least one modified nucleotide.

2. The double stranded RNAi agent of claim 1, wherein the sense strand and the antisense strand each are 30 nucleotides or less in length.

3. The double stranded RNAi agent of claim 1, wherein a plurality of the nucleotides of the sense strand, the antisense strand, or both the sense strand and the antisense strand are modified nucleotides.

4. The double stranded RNAi agent of claim 3, wherein substantially all of the nucleotides of the sense strand, the antisense strand, or both the sense strand and the antisense strand are modified nucleotides.

5. The double stranded RNAi agent of claim 1, wherein the at least one modified nucleotide is selected from the group consisting of a 2'-O-methyl modification, a 2'-deoxy modification, a glycol nucleic acid (GNA), and a 2'-fluoro modification.

6. The double stranded RNAi agent of claim 1, further comprising 6-8 phosphorothioate internucleotide linkages.

7. The double stranded RNAi agent of claim 1, wherein at least one strand comprises a 3' overhang of at least 2 nucleotides or the antisense strand comprises a 3' overhang of at least 2 nucleotides.

8. The double stranded RNAi agent of claim 1, wherein the one or more non-terminal nucleotide positions of the sense strand have the following structure:

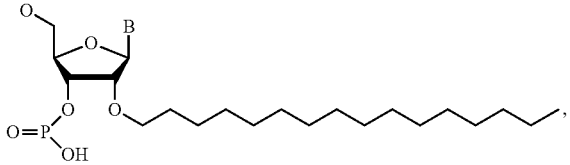

wherein B is a nucleotide base or a nucleotide base analog.

9. The double stranded RNAi agent of claim 1, wherein the antisense strand comprises one or more lipophilic moieties conjugated to one or more non-terminal nucleotide positions.

10. The double stranded RNAi agent of claim 1, wherein the one or more lipophilic moieties are conjugated to any of positions 4-8 of the sense strand counting from the 5' end of the sense strand.

11. The double stranded RNAi agent of claim 1, further comprising a phosphate or a phosphate mimic or a 5'-vinyl phosphonate (VP) group at the 5'-end of the antisense strand.

12. The double stranded RNAi agent of claim 1, further comprising a 5'-vinyl phosphonate (VP) group at the 5'-end of the antisense strand.

13. The double stranded RNAi agent of claim 1, wherein the one or more lipophilic moieties is one lipophilic moiety conjugated to one nucleotide position selected from the group consisting of positions 4, 6, 7, and 8 of the sense strand counting from the 5'-end of the sense strand.

14. The double stranded RNAi agent of claim 1, wherein the one or more lipophilic moieties are only conjugated to one or more of positions 5, 6, 7, 15, and 17 on the sense strand.

15. The double stranded RNAi agent of claim 1, wherein the sense strand comprises the modified nucleotide sequence of 5'-gsgscua(Chd)gadAadAuccaaccusasa-3' (SEQ ID NO:2734) and the antisense strand comprises the modified nucleotide sequence of 5'-VPusUfsaggu(Tgn)ggaud-TuUfcdGuagccsgsu-3' (SEQ ID NO:2742), wherein a, g, c and u are 2'-O-methyl (2'-OMe) A, G, C, and U; s is a phosphorothioate linkage; Uf is 2'-fluoro U; dA, dG, and dT are 2'-deoxy A, G, and T; (Chd) is 2'-O-hexadecyl-cytidine-3'-phosphate; (Tgn) is Thymidine-glycol nucleic acid (GNA)S-Isomer; and VP is 5'-vinyl phosphonate.

16. A pharmaceutical composition for inhibiting expression of an APP gene comprising the double stranded RNAi agent of claim 15.

17. The double stranded RNAi agent of claim 1, wherein:
the sense strand consists of the modified nucleotide sequence of 5'-gsgscua(Chd)gadAadAuccaaccusasa-3' (SEQ ID NO:2734) and;
the antisense strand consists of the modified nucleotide sequence of 5'-VPusUfsaggu(Tgn)ggaud-TuUfcdGuagccsgsu-3' (SEQ ID NO:2742),
wherein a, g, c and u are 2'-O-methyl (2'-OMe) A, G, C, and U; s is a phosphorothioate linkage; Uf is 2'-fluoro U; dA, dG, and dT are 2'-deoxy A, G, and T; (Chd) is 2'-O-hexadecyl-cytidine-3'-phosphate; (Tgn) is Thymidine-glycol nucleic acid (GNA)S-Isomer; and VP is 5'-vinyl phosphonate.

18. A pharmaceutical composition for inhibiting expression of an amyloid precursor protein (APP) gene comprising the double stranded RNAi agent of claim 17.

19. A method of inhibiting expression of an amyloid precursor protein (APP) gene in a cell, the method comprising:
(a) contacting the cell with the pharmaceutical composition of claim 16; and
(b) maintaining the cell of step (a) in contact with the pharmaceutical composition for a time sufficient to degrade mRNA transcripts of the APP gene, thereby inhibiting expression of the APP gene in the cell.

20. The method of claim 19, wherein the APP expression is inhibited by at least about 30%.

21. The method of claim 19, wherein the cell is within a subject.

22. The method of claim 21, wherein the pharmaceutical composition is administered to the subject intrathecally.

23. The method of claim 21, wherein the subject suffers from an APP-associated disorder.

24. The method of claim 23, wherein the APP-associated disorder is selected from the group consisting of a cerebral amyloid angiopathy (CAA), an early onset familial Alzheimer disease (EOFAD), and an Alzheimer's disease (AD).

25. A method of inhibiting expression of an amyloid precursor protein (APP) gene in a cell, the method comprising:
(a) contacting the cell with the pharmaceutical composition of claim 18; and
(b) maintaining the cell of step (a) in contact with the pharmaceutical composition for a time sufficient to obtain degradation of the mRNA transcript of an APP gene, thereby inhibiting expression of the APP gene in the cell.

26. The method of claim 25, wherein the APP expression is inhibited by at least about 30%.

27. The method of claim 26, wherein the cell is within a subject.

28. The method of claim 27, wherein the pharmaceutical composition is administered to the subject intrathecally.

29. The method of claim 27, wherein the subject suffers from an APP-associated disorder.

30. The method of claim 29, wherein the APP-associated disease is cerebral amyloid angiopathy (CAA), early onset familial Alzheimer disease (EOFAD), or Alzheimer's disease (AD).

* * * * *